US012035714B2

(12) United States Patent
Parks et al.

(10) Patent No.: US 12,035,714 B2
(45) Date of Patent: Jul. 16, 2024

(54) PESTICIDAL GENES AND METHODS OF USE

(71) Applicant: AGBIOME, INC., Durham, NC (US)

(72) Inventors: Jessica Parks, Apex, NC (US); Kira Bulazel Roberts, Bahama, NC (US); Rebecca E. Thayer, Morrisville, NC (US)

(73) Assignee: AgBiome, Inc., Durham, NC (US)

( * ) Notice: Subject to any disclaimer, the term of this patent is extended or adjusted under 35 U.S.C. 154(b) by 341 days.

(21) Appl. No.: 17/362,298

(22) Filed: Jun. 29, 2021

(65) Prior Publication Data

US 2022/0272974 A1 Sep. 1, 2022

Related U.S. Application Data

(63) Continuation of application No. 16/419,279, filed on May 22, 2019, now abandoned, which is a continuation of application No. 15/184,324, filed on Jun. 16, 2016, now abandoned.

(60) Provisional application No. 62/182,855, filed on Jun. 22, 2015.

(51) Int. Cl.

| | |
|---|---|
| ***A01N 37/46*** | (2006.01) |
| ***A01N 37/18*** | (2006.01) |
| ***A01N 63/50*** | (2020.01) |
| ***C07K 14/32*** | (2006.01) |
| ***C12N 15/82*** | (2006.01) |

(52) U.S. Cl.

CPC ............. *A01N 37/46* (2013.01); *A01N 37/18* (2013.01); *A01N 63/50* (2020.01); *C07K 14/32* (2013.01); *C12N 15/8261* (2013.01); *C12N 15/8285* (2013.01); *C12N 15/8286* (2013.01); *Y02A 40/146* (2018.01)

(58) Field of Classification Search

None

See application file for complete search history.

(56) References Cited

U.S. PATENT DOCUMENTS

| | | | | |
|---|---|---|---|---|
| 8,461,415 | B2 * | 6/2013 | Sampson | C12N 15/8285 435/468 |
| 8,916,688 | B2 | 2/2014 | Zhang et al. | |
| 8,796,026 | B2 | 8/2014 | Baum et al. | |
| 9,567,381 | B2 | 2/2017 | Kennedy et al. | |
| 2005/0155103 | A1 | 7/2005 | Baum et al. | |
| 2013/0007924 | A1 | 1/2013 | Meade et al. | |
| 2013/0227743 | A1 | 8/2013 | Grandlic et al. | |
| 2014/0033361 | A1 | 1/2014 | Altier et al. | |
| 2017/0101447 | A1 | 4/2017 | Sampson et al. | |

FOREIGN PATENT DOCUMENTS

| | | |
|---|---|---|
| CN | 102066408 | 5/2011 |
| CN | 102796183 | 11/2012 |
| CN | 103946393 | 7/2014 |
| RU | 2382822 | 2/2010 |
| WO | WO 1996/10083 | 4/1996 |
| WO | WO 2001/19859 | 3/2001 |
| WO | WO 2005/019414 | 3/2005 |
| WO | WO 2009/052242 | 4/2009 |
| WO | WO 2010/099365 | 9/2010 |
| WO | WO 2011/014749 | 2/2011 |
| WO | WO 2011/041256 | 4/2011 |
| WO | WO 2012/024372 | 2/2012 |

OTHER PUBLICATIONS

Finn et al., "Pfam: the protein families database," Nucleic Acids Research, 2014, 42:D222-D230.

GenBank Accession No. ABL01536.1, "crystal protein [Bacillus thuringiensis]," Dec. 6, 2006, via internet at https://www.ncbi.nlm.nih.gov/protein/ABL01536.

GenBank Accession No. AGU13825.1, "pesticidal protein [Bacillus thuringiensis]"; Nov. 14, 2013; via internet at https://www.ncbi.nlm.nih.gov/protein/agu13825.1.

GenBank Accession No. AIE37446.1, "Cry2Aa (plasmid) [Bacillus thuringiensis serovar kurstaki str. HD-1]," Jul. 26, 2016, via internet at https://www.ncbi.nlm.nih.gov/protein/aie37446.1.

GenBank Accession No. ATK48604.1, "Sequence 254 from U.S. Pat. No. 9,567,381," Oct. 13, 2017, via internet at https://www.ncbi.nlm.nih.gov/protein/ATK48604.1.

GenBank Accession No. CAZ39518.1, "unnamed protein product, partial [Bacillus thuringiensis]," Jun. 2, 2009, via internet at https://www.ncbi.nlm.nih.gov/protein/CAZ39518.1.

GenBank Accession No. CAZ39519.1, "unnamed protein product, partial [synthetic construct]," Jun. 2, 2009, via internet at https://www.ncbi.nlm.nih.gov/protein/CAZ39519.1.

GenBank Accession No. CAZ39521.1, "unnamed protein product, partial [synthetic construct]," Jun. 2, 2009, via internet at https://www.ncbi.nlm.nih.gov/protein/CAZ39521.1.

(Continued)

*Primary Examiner* — Russell Kallis

(74) *Attorney, Agent, or Firm* — Womble Bond Dickinson (US) LLP

(57) ABSTRACT

Compositions having pesticidal activity and methods for their use are provided. Compositions include isolated and recombinant polypeptides having pesticidal activity, recombinant and synthetic nucleic acid molecules encoding the polypeptides, DNA constructs and vectors comprising the nucleic acid molecules, host cells comprising the vectors, and antibodies to the polypeptides. Nucleotide sequences encoding the polypeptides can be used in DNA constructs or expression cassettes for transformation and expression in organisms of interest. The compositions and methods provided are useful for producing organisms with enhanced pest resistance or tolerance. Transgenic plants and seeds comprising a nucleotide sequence that encodes a pesticidal protein of the invention are also provided. Such plants are resistant to insects and other pests. Methods are provided for producing the various polypeptides disclosed herein, and for using those polypeptides for controlling or killing a pest. Methods and kits for detecting polypeptides of the invention in a sample are also included.

17 Claims, No Drawings

Specification includes a Sequence Listing.

(56) References Cited

OTHER PUBLICATIONS

GenBank Accession No. EEM68648.1, hypothetical protein bthur0009_52910 [Bacillus thuringiensis serovar andalousiensis Bgsc 4AW1], Apr. 30, 2009.
GenBank Accession No. EEM92620.1, hypothetical protein bthur0013_60420 [Bacillus thuringiensis IBL200], Apr. 30, 2009.
GenBank Accession No. EJP85763.1, hypothetical protein IC1_04516 [Bacillus cereus VD022], Aug. 15, 2012.
GenBank Accesion No. EOO05468.1, hypothetical protein IAW_05134 [Bacillus cereus str. Schrouff], May 16, 2013.
GenBank Accession No. EOO82372.1, hypothetical protein IGY_05229 [Bacillus cereus K-5975c], May 16, 2013.
GenBank Accession No. EOQ59841.1, hypothetical protein IAY_04046 [Bacillus cereus TIAC219], May 16, 2013.
NCBI Reference Sequence: WP_042970272.1, "pesticidal crystal protein cry2Aa [Bacillus thuringiensis]," Apr. 6, 2015, via internet at https://www.ncbi.nlm.nih.gov/protein/WP_042970272.1.
Hashem et al., "Bacillus subtilis: A plant-growth promoting rhizobacterium that also impacts biotic stress," Saudi J Biological Sciences, 2019, 26:1291-1297.
Xu et al., "Structural Insights into *Bacillus thuringiensis* Cry, Cyt and Parasporin Toxins," Toxins, 2014, 6:2732-2770.
Yong, "Gene Engineering and Agriculture," Scientific and Technical Documentation Press, Dec. 31, 1994, pp. 155-161, with machine translation.
Ekino et al., "Cloning and Characterization of a Unique Cytotoxic Protein Parasporin-5 Produced by Bacillus thuringiensis A1100 Strain," Toxins, 2014, 6:1882-1895.
GenBank Accession No. AB555650.1, "Bacillus thuringiensis ps-5 gene for crystal protein, complete cds," Jul. 10, 2014.
GenBank Accession No. AGT29559.1, "parasporin 5-1 [Bacillus thuringiensis]," Dec. 15, 2015.
GenBank Accession No. AGT29560.1, "parasporin 5-2 [Bacillus thuringiensis]," Dec. 15, 2015.

* cited by examiner

PESTICIDAL GENES AND METHODS OF USE

CROSS REFERENCE TO RELATED APPLICATIONS

This application is a continuation of U.S. Nonprovisonal application Ser. No. 16/419,279, filed on May 22, 2019, which is a continuation of U.S. Nonprovisonal application Ser. No. 15/184,324, filed on Jun. 16, 2016, which claims the benefit of and priority to U.S. Provisional Application Ser. No. 62/182,855, filed Jun. 22, 2015, each of which are herein incorporated by reference in their entirety.

FIELD OF THE INVENTION

The invention is drawn to methods and compositions for controlling pests, particularly plant pests.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named AGB015US-CON2-SeqListing.txt, created on Jun. 28, 2021, and having a size of 952,563 bytes and is filed concurrently with the specification. The sequence listing contained in this ASCII formatted document is part of the specification and is herein incorporated by reference in its entirety.

BACKGROUND

Pests, plant diseases, and weeds can be serious threats to crops. Losses due to pests and diseases have been estimated at 37% of the agricultural production worldwide, with 13% due to insects, bacteria and other organisms.

Toxins are virulence determinants that play an important role in microbial pathogenicity and/or evasion of the host immune response. Toxins from the gram-positive bacterium *Bacillus*, particularly *Bacillus thuringensis*, have been used as insecticidal proteins. Current strategies use the genes expressing these toxins to produce transgenic crops. Transgenic crops expressing insecticidal protein toxins are used to combat crop damage from insects.

While the use of *Bacillus* toxins has been successful in controlling insects, resistance to Bt toxins has developed in some target pests in many parts of the world where such toxins have been used intensively. One way of solving this problem is sowing Bt crops with alternating rows of regular non Bt crops (refuge). An alternative method to avoid or slow down development of insect resistance is stacking insecticidal genes with different modes of action against insects in transgenic plants. The current strategy of using transgenic crops expressing insecticidal protein toxins is placing increasing emphasis on the discovery of novel toxins, beyond those already derived from the bacterium *Bacillus thuringiensis*. These toxins may prove useful as alternatives to those derived from *B. thuringiensis* for deployment in insect- and pest-resistant transgenic plants. Thus, new toxin proteins are needed.

SUMMARY

Compositions having pesticidal activity and methods for their use are provided. Compositions include isolated and recombinant polypeptide sequences having pesticidal activity, recombinant and synthetic nucleic acid molecules encoding the pesticidal polypeptides, DNA constructs comprising the nucleic acid molecules, vectors comprising the nucleic acid molecules, host cells comprising the vectors, and antibodies to the pesticidal polypeptides. Nucleotide sequences encoding the polypeptides provided herein can be used in DNA constructs or expression cassettes for transformation and expression in organisms of interest, including microorganisms and plants.

The compositions and methods provided herein are useful for the production of organisms with enhanced pest resistance or tolerance. These organisms and compositions comprising the organisms are desirable for agricultural purposes. Transgenic plants and seeds comprising a nucleotide sequence that encodes a pesticidal protein of the invention are also provided. Such plants are resistant to insects and other pests.

Methods are provided for producing the various polypeptides disclosed herein, and for using those polypeptides for controlling or killing a pest. Methods and kits for detecting polypeptides of the invention in a sample are also included.

DETAILED DESCRIPTION OF THE INVENTION

The present inventions now will be described more fully hereinafter. Indeed, these inventions may be embodied in many different forms and should not be construed as limited to the embodiments set forth herein; rather, these embodiments are provided so that this disclosure will satisfy applicable legal requirements.

Many modifications and other embodiments of the inventions set forth herein will come to mind to one skilled in the art to which these inventions pertain having the benefit of the teachings presented in the foregoing descriptions. Therefore, it is to be understood that the inventions are not to be limited to the specific embodiments disclosed and that modifications and other embodiments are intended to be included within the scope of the appended claims. Although specific terms are employed herein, they are used in a generic and descriptive sense only and not for purposes of limitation.

I. Polynucleotides and Polypeptides

Compositions and method for conferring pesticidal activity to an organism are provided. The modified organism exhibits pesticidal resistance or tolerance.

Recombinant pesticidal proteins, or polypeptides and fragments and variants thereof that retain pesticidal activity, are provided and include those set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, and/or 224. The pesticidal proteins are biologically active (e.g., pesticidal) against pests including insects, fungi, nematodes, and the like. Nucleotides encoding the pesticidal polypeptides, including for example, SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, and/or 224, or active fragments or variants thereof, can be used to produce transgenic organisms, such as plants and microorganisms. The pesticidal proteins are biologically active (for example, are pesticidal) against pests including insects, fungi, nematodes, and the like. Polynucleotides encoding the pesticidal polypeptides, including for example, SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, and/or 224, or active fragments or variants thereof, can be used to produce transgenic organisms, such as plants and microorganisms. The transformed organisms are characterized by genomes that comprise at least one stably incorporated DNA construct comprising a coding sequence for a pesticidal protein disclosed herein. In some embodiments, the coding sequence is operably linked to a promoter that drives expression of the encoded pesticidal polypeptide. Accordingly, transformed microorganisms, plant cells, plant tissues, plants, seeds, and plant parts are provided. A summary of various polypeptides, active variants and fragments thereof, and polynucleotides encoding the same are set forth below in Table 1. As noted in Table 1, various forms of polypeptides are provided. Full length pesticidal polypeptides, as well as, modified versions of the original full-length sequence (i.e., variants) are provided. Table 1 further denotes "CryBP1" sequences. Such sequences (SEQ ID NOs: 11 and 93) comprise accessory polypeptides that can be associated with some of the toxin genes. In such instances, the CryBP1 sequences can be used alone or in combination with any of the pesticidal polypeptides provided herein. Table 1 further provides Split-Cry C-terminus polypeptides (SEQ ID NO: 106). Such sequence comprise the sequence of a downstream protein that has homology to the C-terminal end of the Cry class of toxin genes and are usually found after a Cry gene that is not full-length and is missing the expected C-terminal region.

TABLE 1

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00078 | 1 | 2 | | | WP_036684392.1 (54.3% identity,<br>WP_016123021.1 (53.1% identity, 67.1% similarity)<br>WP_016084067.1 (52.9% identity, 67.7% similarity) | PI-PLC | 55, 60, 65, 70, 75, 80, 85, 90, 95, 96, 97, 98, 99 | 70, 75, 80, 85, 90, 95, 96, 97, 98, 99 |
| APG00306 | 3 | | | | APG00600 (92.8% identity, 95.5% similarity)<br>APG00212 (83.9% identity, 90.5% similarity)<br>APG00619 (82.9% identity, 90.3% similarity)<br>APG00592 (81.0% identity, 88.8% similarity)<br>APG00798 (80.8% identity, 88.6% similarity)<br>US20130227743A1_146 (72.8% identiyy, 81.7% similarity)<br>WP_002166959.1 (67.5% identity, 77.7% similarity)<br>WP_002191947.1 (67.2% ident.ty, 77.7% similarity)<br>APG00336 (59.0% identity, 69.0% similarity) | Bin | 75, 80, 85, 90, 95, 96, 97, 98, 99 | 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | APG00331 (57.2% identity, 70.4% similarity)<br>APG00551 (50.9% identity, 60.2% similarity)<br>Cry35Ab3 (21.4% identity, 35.9% similarity) | | | |
| APG00310 | 4 | 5 | | | APG00054 (72.1% identity, 79.8% similarity)<br>APG00068 (70.8% identity, 80.5% similaiity)<br>AGU13832.1 (63.0% identify, 75.1% similarity)<br>AGU13851.1 (62.5% identity, 72.2% similarity)<br>Cry32Ea1 (62.5% identity, 72.1% similarity)<br>APG00469 (57.2% identity, 68.8% similarity)<br>APG00105 (53.5% identity, 65.5% similarity)<br>APG00430 (53.0% identity, 63.8% similarity)<br>APG00504 (51.2% identity, 62.1% similarity)<br>APG00056 (51.0% identity, 62.2% similarity) | Cry32 | 65, 70, 75, 80, 85, 90, 95, 96, 97, 98, 99 | 80, 85, 90, 95, 96, 97, 98, 99 |
| APG00311 | 6 | 139 | | | US20130227743A1_106 (46.7% identity, 61.2% similarity)<br>AGA40043.1 (27.2% identity, 37.1% similarity)<br>W8YCZ9_BACTU (21.4% identity, 37.7% similarity)<br>KEZ79637.1 (19.3% identity, 31.75 similarity) | Mtx | 50, 55, 60, 65, 70, 75, 80, 85, 90, 95, 96, 97, 98, 99 | 65, 70, 75, 80, 85, 90, 95, 96, 97, 98, 99 |
| APG00312 | 7 | | | | APG00951 (95.5% identity, 96.3% similarity)<br>APG00342 (90.7% identity, 94.9% similarity)<br>WP_002144456.1 (88.7% identity, 93.8% similarity)<br>WP_002169783.1 (84.7% identity, 91.2% similarity)<br>APG00432 (73.1% identity, 85.0% similarity)<br>WP_000240777.1 (68.0% identity, 82.7% similarity)<br>APG00631 (65.7% identity, 81.9% similarity)<br>APG00024 (65.7% identity, 81.1% similarity)<br>APG00180 (62.9% identity, 78.8% similarity)<br>Cry6Ba1 (27.5% identity, 45.9% similarity) | Cry6 | 90, 95, 96, 97, 98, 99 | 95, 96, 97, 98, 99 |
| APG00313 | 8 | | | | AGA40057.1 (35.6% identity, 49.3% similarity)<br>AGA40058.1 (27.0% identity, 42.3% similarity)<br>US20130227743A1_206 (27.0% identity, 40.9% similarity)<br>WP_017762619.1 (26.9% identity, 41.0% similarity) | Cry | 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00316 | 9 | 10, 140, 141 | 11 | | Cry4Aa2 (35.6% identity, 53.1% similarity)<br>A9X135_BACTU (35.6% identity, 52.9% similarity) | Cry | 40, 45, 50, 55, 60, 65, 70, 75, 80, 85, 90, 95, 96, 97, 98, 99 | 55, 60, 65, 70, 75, 80, 85, 90, 95, 96, 97, 95, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00325 | 12 | 142 | | | WP_016099611.1 (60.1% identity, 72.9% similarity)<br>WP_016098287.l (40.3% identity, 59.4% similarity)<br>EOP91365.1 (37.6% identity, 54.1% similarity)<br>A0A015NB99_BACTU (28.1% identity, 42.4% similarity) | Mtx | 65, 70, 75, 80 85, 90, 95, 96, 97, 98, 99 | 75, 80, 85, 90, 95, 96, 97, 98, 99 |
| A0G00327 | 13 | 143 | | | APG00108 (60.6% identity, 70.6% similarity)<br>WP_030313032.1, (57.4% identity, 66.3% similarity)<br>EST18904.1 (57.3% identity, 65.9% similarity)<br>APG00134 (57.0% identity, 65.9% similarity)<br>WP_031227301.1 (56.6% identity, 64.0% similarity)<br>APG00138 (52.6% identity, 60.8% similarity)<br>Cyt2Aa2 (21.4% identity, 39.8% similarity) | Cyt | 60, 65, 70, 75, 80, 85, 90, 95, 96, 97, 98, 99 | 70, 75, 80, 85, 90, 95, 96, 97, 98, 99 |
| APG00328 | 14 | | | | WP_015345272.1 (34.3% identity, 58.0% similarity)<br>WP_016110619.1 (20.6% identity, 41.7% similarity)<br>WP_001104853.1 (19.4% identity, 40.3% similarity)<br>WP_002187785.1 (18.8% identity, 40.0% similarity) | Cry6 | 35, 40, 45, 50, 55, 60, 65, 70, 75, 80, 85, 90, 95, 96, 97, 98, 99 | 60, 65, 70, 75, 80, 85, 90, 95, 96, 97, 98, 99 |
| APG00331 | 15 | 144 | | | US20130227743A1_2 (67.3% identity, 77.9% similarity)<br>WP_000727408.1 (66.7% identity, 77.2% similarity)<br>WP_016110923.1 (66.7% identity, 76.9% similarity)<br>APG00141 (65.9% identity, 76.4% similarity)<br>APG00118 (59.7% identity, 70.0% similarity)<br>APG00913 (58.2% identity, 67.4% similarity)<br>APG00335 (58.1% identity, 67.0% similarity)<br>APG00306 (57.2% identity, 70.4% similarity)<br>APG00336 ( 57.1% identity, 68.2% similarity)<br>APG00320 (56.5% identity, 66.7% similarity)<br>APG00398 (55.4% identity, 63.4% similarity)<br>Cry35Ba1 (21.8% identity, 36.8% similarity) | Bin | 70, 75, 80, 85, 90, 95, 96, 97, 98, 99 | 80, 85, 90, 95, 96, 97, 98, 99 |
| APG00333 | 16 | 145 | | | WP_036146575.1 (36.8% identity, 52.8% similarity)<br>WP_000794514.1 (36.6% identity, 51.0% similarity)<br>WP_036224766.1 (36.5% identity, 52.5% similarity)<br>US20130227743A1_102 (35.2% identity, 50.0% similarity) | Mtx | 40, 45,50 55, 60, 65, 70, 75, 80, 85, 90, 95, 96, 97, 98, 99 | 55, 60, 65, 70, 75, 80, 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00334 | 17 | 146 | | | US20130227743A1_200 (26.6% identity, 42.6% similarity)<br>AGA40058.1. (23.5% identity, 37.8% similarity)<br>US_2013_0227743_A1_178 (23.5% identity, 35.5% similarity)<br>Cry73Aa (17.3% identity, 27.3% similarity) | Cry | 30, 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 |
| APG00335 | 18 | 147 | | | APG00223 (98.1% identity, 99.1% similarity)<br>APG00242 (97.9% identity, 99.1% similarity)<br>APG00454 (97.2% identity, 98.8% similarity)<br>APG00118 90.6% identity, 94.7% similarity)<br>US20130227743A1_10 (85.6% identity, 88.4% similarity)<br>WP_001258160.1 (85.4% identity, 88.2% similarity)<br>WP_001258161.1 (85.2% identity, 88.0% similarity)<br>APG00913 (84.9% identity, 89.6% similarity)<br>APG00336 (67.7% identity, 78.4% similarity)<br>APG00331 (58.1% identity, 67.0% similarity)<br>Cry35Ab4 (19.1 identity, 34.1% similarity) | Bin | 90, 95, 96, 97, 98, 99 | 90, 95, 96, 97, 98, 99 |
| APG00336 | 19 | 148 | | | APG00262 (79.5% identity, similarity)<br>WP_002191947.1 (75.8% identity, 83.1% similarity)<br>WP_002166959.1 (75.5% identity, 83.1% similarity)<br>WP_000839920.1 (73.5% identity, 80.3% similarity)<br>APG00243 (70.7% identity, 77.0% similarity)<br>APG00065 (69.1% identity, 76.9% similarity)<br>APG00925 (68.6% identity, 79.0% similarity)<br>APG00335 (67.7% identity, 78.4% similarity)<br>APG00369 (66.3% identity, 76.5% similarity)<br>APG00306 (59.0% identity, 69.0% similarity)<br>APG00331 (57.1% identity, 68.2% similarity)<br>Cry49Aa1 (22.1% identity, 35.8% similaiity) | Bin | 80, 85, 90, 95, 96, 97, 98, 99 | 85, 90, 95, 96, 97, 98, 99 |
| APG00337 | 20 | 149 | | | US20130227743A1_108 (93.4% identity, 96.7% similarity)<br>WP_014990472.1 (92.4% identity, 97.3% similarity)<br>WP_002204230.1 (92.4% identity, 96.3% similarity)<br>WP_002166571.1 (92.0% identity, 96.0% similarity)<br>APG00299 (89.1% identity, 94.7% similarity) | Mtx | 95, 96, 97, 98, 99 | 98, 39 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | APG00350 (58.7% identity, 74.9% similarity)<br>APG00010 (58.0% identity, 74.1% similarity) | | | |
| APG00338 | 21 | | | | APG00447 (53.9% identity, 58.9% similarity)<br>WP_033728980.1 (48.0% identity, 52.0% similarity)<br>ETT84678.1 (44.8% identity, 54.0% similarity)<br>WP_016084067.1 (39.3% identity, 53.9% similarity)<br>Cry41Ab1 (16.8% identity, 27.9% similarity) | PI-PLC | 50, 55, 60, 65, 70, 75, 80, 85, 90, 95, 96, 97, 98, 99 | 55, 60, 65, 70, 75, 80, 85, 90, 95, 96, 97, 98, 99 |
| APG00344 | 22 | 150 | | | APG00477 (72.7% identity, 83.6% similarity)<br>WP_016098287.1 (72.4% identity, 83.3% similarity)<br>APG00384 (56.5% identity, 72.4% similarity)<br>EOP91365.1 (45.9% identity, 63.9% similarity)<br>WP_016099611.1 (40.0% identdy, 60.6% similarity)<br>W2E623_9BACL (30.0% identity, 44.8% similarity) | Mtx | 75, 80, 85, 90, 95, 96, 97, 98, 99 | 85, 90, 95, 96, 97, 98, 99 |
| APG00345 | 23 | | | | APG00107 (75.0% identity, 85.1% similarity)<br>US20130227743A1_100 (71.7% identity, 85.0% similarity)<br>APG00067 (71.5% identity, 83.2% similarity)<br>APG00006 (70.9% identity, 82.4% similarity)<br>APG00137 (70.7% identity, 81.6% similarity)<br>WP_000963933.1 (70.0% identity, 83.6% similarity)<br>APG00201 (69.1% identity, 81.6% similarity)<br>US20130227743A1_60 (39.7% identity, 47.0% similarity)<br>WP_026272455.1 (25.8% identity, 40.7% similarity) | Mtx | 75, 80, 85, 90, 95, 96, 97, 98, 99 | 90, 95, 96, 97, 98, 99 |
| APG00346 | 24 | | | | AGT29559.1 (53.4% identity, 68.2% similarity)<br>AGT29560.1 (46.5% identity, 61.3% similarity)<br>Cry64Aa1 (41. 7% identity, 59.6% similarity) | Mtx | 55, 60, 65, 70, 75, 80, 85, 90, 95, 96, 97, 98, 99 | 70, 75, 80, 85, 90, 95, 96, 97, 98, 99 |
| APG00347 | 25 | 151 | | | US20130227743A1_112 (27.6% identity, 43.8% similarity)<br>US20130227743A1_114 (26.9% identity, 45.1% similarity)<br>WP_000239374.1 (25.8% identity, 43.5% similarity)<br>WP_006918908.1 (24.1% identity, 40.4% similarity) | Mtx | 30, 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00348 | 26 | 152 | | | US20130227743A1_200 (77.2% identity, 82.0% similarity)<br>WP_017762581.1 (31.4% identity, 44.6% similarity)<br>AGP17992.1 (29.4% identity, 42.6% similarity)<br>Cry42Aa1 (17.7% identity, 29.5% similarity) | Cry | 80, 85, 90, 95, 96, 97, 98, 99 | 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00350 | 27 | 153 | | | WP_036131420.1 (61.6% identity, 74.8% similarity)<br>WP_036122586.1 (61.0% ideally, 74.4% similarity)<br>EON72391.1 (60.5% identity, 73.5% similarity)<br>WP_014990472.1 (60.1% identity, 75.2% similarity)<br>APG00010 (59.0% identity, 72.2% similarity)<br>APG00337 (58.7% identity, 74.9% similarity)<br>APG00299 (57.0% identity, 74.1% similarity) | Mtx | 65, 70, 75, 80, 85, 90, 95, 96, 97, 98, 99 | 80, 85, 90, 95, 96, 97, 98, 99 |
| APG00351 | 28 | 154 | | | APG00590 (76.3% identity, 84.8% similarity)<br>AGA40045.1 (64.0% identity, 6.2% similarity)<br>APG00146 (62.6% identity, 73.3% similarity)<br>WP_000794514.1 (61.7% identity, 73.6% similarity)<br>APG00387 (59.5% identity, 72.1% similarity)<br>US20130227743A1_102 (56.6% identity, 69.3% similarity)<br>APG00563 (54.6% identity, 68.3% similarity)<br>APG00938 (53.8% identity, 68.9% similarity)<br>APG00794 (53.6% identity, 68.2% similarity)<br>APG00423 (51.3% identity, 63.3% similarity)<br>WP_036654376.1 (41.7% identity, 56.0% similarity) | Mtx | 65, 70, 75, 80, 85, 90, 95, 96, 97, 98, 99 | 80, 85, 90, 95, 96, 97, 98, 99 |
| APG00352 | 29 | 155 | | | WP_016123567.1 (81.3% identity, 89.7% similarity)<br>WP_00202 (80.1% identity, 86.1% similarity)<br>APG00208 (79.8% identity, 86.6% similarity)<br>WP_000715637.1 (73.9% identity, 84.2% similarity)<br>U820130227743A1_122 (30.5% identity, 48.2% similarity)<br>R8TCG2_BACCE (24.7% identity, 37.2% similarity) | Mtx | 85, 90, 95, 96, 97, 98, 99 | 90, 95, 96, 97, 98, 99 |
| APG00357 | 30 | | | | Cyt1Aa6 (18.8% identity, 37.6% similarity)<br>WP_000429377.1 (18.8% identity, 37.6% similarity) | Cyt | 20, 25, 30, 35, 40, 45, 50, 55, 60, 65, 70, 75, 80, 85, 90, 95, 96, 97, 98, 99 | 40, 45, 50, 55, 60, 65, 70, 75, 80, 85, 90, 95, 96, 97, 98, 99 |
| APG00358 | 31 | 156 | | | APG00278 (86.5% identity, 91.9% similarity)<br>APG00173 (85.7% identity, 90.7% similarity)<br>APG00875 (85.3% identity, 90.1% similarity)<br>APG00077 (74.2% identity, 82.0% similarity)<br>APG00175 (72.9% identity, 80.7% similarity)<br>KEZ80024.1 (72.8% identity, 83.4% similarity) | Vip3 | 75, 80, 85, 90, 95, 96, 97, 98, 99 | 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | APG00104 (68.9% identity, 78.7% similarity)<br>Vip3Af1 (24.5% identity, 41.7% similarity) | | | |
| APG00361 | 32 | | | | US_587428_A-8 (31.6% identity, 52.5% similarity)<br>Cry6Ba1 (31.4% identity, 49.8% similarity) | Cry6 | 35, 40, 45, 50, 55, 60, 65, 70, 75, 80, 85, 90, 95, 96, 97, 98, 99 | 55, 60, 65, 70, 75, 80, 85, 90, 95, 96, 97, 98, 99 |
| APG00362 | 33 | 157 | | | APG00552 (54.8% identity, 73.5% similarity)<br>WP_016078640.1 (53.0% identity, 72.6% similarity)<br>WP_036654376.1 (47.2% identity, 61.5% similarity)<br>WP_033699741.1 (47.4% identity, 63.3% similarity)<br>ETK27180.1 (46.3% identity, 60.0% similarity) | Mtx | 55, 60, 65, 70, 75 80, 85, 90, 95, 96, 97, 98, 99 | 75, 80, 85, 90, 95, 96, 97 98, 99 |
| APG00363 | 34 | 158 | | | APG00285 (98.5% identity, 99.0% similarity)<br>AGA40057.1 (31.7% identity, 48.4% similarity)<br>WP_017762581.1 (30.3% identity, 45.0% similarity)<br>AGP17992.1 (30.2% identity, 43.9% similarity)<br>WP_017762616.1 (30.0% identity, 45.0% similarity) | Cry | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 94, 99 |
| APG00364 | 35 | 159 | | | AGA40042.1 36.6% identily, 52.3% similarity)<br>AGA40043.1 (35.7% identity, 51.1% similarity)<br>US_8829279_B2-11 (28.7% identity, 45.7% similarity)<br>WP_000844424.1 (27.9% identity, 46.1% similarity) | Mtx | 40, 45, 50, 55, 60, 65, 70, 75, 80, 85, 90, 95, 96, 97, 98, 99 | 55, 60, 65, 70, 75, 80, 85, 90, 95, 96, 97, 98, 99 |
| APG00365 | 36 | 160 | | | AGA40061.1 (36.2% identity, 50.5% similarity)<br>Cry64Aa1 (34.9% identity, 49.4% similarity) | Mtx | 40, 45, 50, 55, 60, 65, 70, 75, 80, 85, 90, 95, 96, 97, 98, 99 | 55, 60, 65, 70, 75, 80, 85, 90, 95, 96, 97, 98, 99 |
| APG00366 | 37 | 161 | | | APG00129 (58.6% identity, 73.4% similarity)<br>WP_030030026.1 (57.3% identity, 71.5% similarity) | Mtx | 60, 65, 70, 75, 80, 85, 90, 95, 96, 97, 98, 99 | 75, 80, 85, 90, 95, 96, 97, 98, 99 |
| APG00370 | 38 | 39, 162, 163 | | | AGA40033.1 (48.5% identity, 63.2% 63.2% similarity)<br>AGP18005.1 (48.5% identity, 62.5% similarity)<br>AEH76823.1 (45.9% identity, 60.5% similarity)<br>Cry14Aa1 (37.1% identity, 50.7% similarity) | Cry | 50, 55, 60, 65, 70, 75, 80, 85, 90, 95, 96, 97, 98, 99 | 65, 70, 75, 80, 85, 90, 95, 96, 97, 98, 99 |
| APG00374 | 40 | 41, 164 | | | ABR22235.1 (37.2% identity, 54.5% similarity)<br>Ciy4Ba1 (37.1% identity, 54.8% similarity)<br>AAW55474.1 (37.1% identity, 54.8% similarity) | Cry | 40, 45, 50, 55, 60, 65, 70, 75, 80, 85, 90, 95, 96, 97, 98, 99 | 55, 60, 65, 70, 75, 80, 85, 90, 95, 96, 97, 98, 99 |
| APG00378 | 42 | 165 | | | WP_000162995.1 (57.0% identity, 74.9% similarity)<br>WP_033693474.1 (57.0% identity, 74.9% similarity)<br>WP_000162978.1 (56.8% identity, 74.7% similarity)<br>WP_000162983.1 (56.8% identity, 74.7% similarity) | Cry6 | 60, 65, 70, 75, 80, 85, 90, 95, 96, 97, 98, 99 | 75, 80, 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | APG00274 (53.5% identity, 74.7% similarity) | | | |
| APG00380 | 43 | | | | APG00191 (85.9% identity, 91.6% similarity)<br>APG00449 (84.3% identity, 91.1% similarity)<br>KEZ80012.1 (66.1% identity, 77.7% similarity)<br>APG00230 (64.8% identity, 77.8% similarity)<br>APG00413 (63.4% identity, 76.2% similarity)<br>APG00741 (61.8% identity, 74.0% similarity)<br>WP_017154552.1 (60.3% identity, 73.2% similarity)<br>APG00596 (59.0% identity, 71.9% similarity)<br>APG00482 (57.0% identity, 68.5% similarity)<br>WP_003308586.1 (45.7% identity, 61.2% similarity)<br>Cry49Aa1 (19.2% identity, 31.9% similarity) | Bin | 70, 75, 80, 85, 90, 95, 96, 97, | 80, 85, 90, 95, 96, 97, 98, 99 |
| APG00384 | 44 | 166 | | | APG00344 (56.5% identity, 72.4% similarity)<br>WP_016098287.1 (55.4% identity, 70.3% similarity)<br>APG00477 (54.8% identity, 69.8% similarity)<br>WP_016099611.1 (52.9% identity, 66.8% similarity)<br>EOP91365.1 (48.0% identity, 62.7% similarity)<br>WP_033699741.1 (32.0% identity, 50.1% similarity) | Mtx | 60, 65, 70, 75, 80, 85, 90, 95, 96, 97, 98, 99 | 75, 80, 85, 90, 95, 96, 97, 98, 99 |
| APG00387 | 45 | 167 | | | APG00590 (65.4% identity, 77.7% similarity)<br>WP_000794514.1 (63.3% identity, 74.2% similarity)<br>APG00938 (61.8% identity, 75.5% similarity)<br>APG00569 (61.1% identity, 74.9% similarity)<br>US20130227743A1_102 (61.0% identity, 76.2% similarity)<br>APG00563 (60.5% identity, 74.4% similarity)<br>APG00794 (59.6% identity, 74.5% similarity)<br>APG00351 (59.5% identity, 72.1% similarity)<br>AGA40045.1 (59.5% identity, 71.6% similarity)<br>APG00423 (57.5% identity, 70.4% similarity)<br>WP_036654376.1 (46.5% identity, 61.0% similarity) | Mtx | 65, 70, 75, 80, 85, 90, 95, 96, 97, 98, 99 | 80, 85, 90, 95, 96, 97, 98, 99 |
| APG00389 | 46 | 47, 168 | | | APG00040 (53.8% identity, 64.4% similarity)<br>US_8299217_B2-28 (27.9% identity, 43.2% similarity)<br>AHG25301.1 (18.6% identity, 27.1% similarity)<br>Cry4Ce1 (18.3% identity, 26.8% similarity) | Cry | 30, 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00394 | 48 | 169 | | | US20130227743A1_98 (87.6% identity, similarity)<br>WP_000499738.1 (30.4% identity, 52.7% similarity)<br>US20130227743A1_94 (30.2% identity, 52.0% similarity)<br>Cyt2Ca1 (27.5% identity, 53.6% similarity) | Cyt | 90, 95, 96, 97, 98, 99 | 96, 97, 98, 99 |
| APG00405 | 49 | 170 | | | WP_002090287. (62.8% identity, 78.1% similarity)<br>WP_034643273.1 (51.1% identity, 70.9% similarity)<br>WP_000415293.1 (50.8% identity, 70.1% similarity)<br>WP_001245421.1 (50.5% identity, 69.5% similarity) | Cry6 | 65, 70, 75, 80, 85, 90, 95, 96, 97, 98, 99 | 80, 85, 90, 95, 96, 97, 98, 99 |
| APG00406 | 50 | 171 | | | WP_000875422.1 (77.3% identity, 86.4% similarity)<br>WP_000875423.1 (76.5% identity, 86.1% similarity)<br>WP_000797173.1 (76.3% identity, 85.6% similarity)<br>US20060191034A1_8 (75.6% identity, 83.4% similarity)<br>APG00476 (74.7% identity, 83.1% similarity)<br>APG00174 (74.4% identity, 82.6% similarity)<br>APG00055 (73.3% identity, 85.3% similarity)<br>APG00064 (64.8% identity, 78.2% similarity)<br>APG00768 (63.5% identity, 77.9% similarity) | Mtx | 80, 85, 90, 95, 96, 97, 98, 99 | 90, 95, 96, 97, 98, 99 |
| APG00423 | 51 | 172 | | | US20130227743A1_102 (79.7% identity, 86.6% similarity)<br>APG00590 (57.7% identity, 69.5% similarity)<br>WP_000794514.1 (57.6% identity, 70.4% similarity)<br>APG00387 (57.5% identity, 70.4% similarity)<br>APG00146 (57.4% identity, 69.6% similarity)<br>APG00794 (52.8% identity, 67.4% similarity)<br>APG00938 (52.4% identity, 67.4% similarity)<br>APG00563 (52.3% identity, 65.5% similarity)<br>APG00351 (51.3% identity, 63.3% similarity)<br>AGA40045.1 (51.1% identity, 65.0% similarity)<br>ETK27180.1 (44.5% identity, 59.2% similarity) | Mtx | 80, 85, 90, 95, 96, 97, 98, 99 | 90, 95, 96, 97, 98, 99 |
| APG00424 | 52 | | | | APG00329 (82.0% identity, 85.4% similarity)<br>WP_017762581.1 (80.2% identity, 83.4% similarity)<br>AGP17992.1 (77.9% identity, 85.4% similarity)<br>WP_017762619.1 (30.5% identity, 45.7% similarity)<br>US20130227743A1_206 (29.6% identity, 44.9% similarity) | Cry | 85, 90, 95, 96, 97, 98, 99 | 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00429 | 53 | 173 | | | APG00994 (59.4% identity, 74.8% similarity)<br>WP_033694378.1 (39.9% identity, 51.7% similarity)<br>US20060191034A1_33 (26.7% identity, 40.2% similarity)<br>US20060191034A1_10 (25.8% identity, 41.0% similarity)<br>US_8796026_B2-4 (25.7% identity, 38.2% similarity) | Mtx | 40, 45, 50, 55, 60, 65, 70, 75, 80, 85, 90, 95, 96, 97, 98, 99 | 55, 60, 65, 70, 75, 80, 85, 90, 95, 96, 97, 98, 99 |
| APG00430 | 54 | 55 | | | AGU13855.1 (78.4% identity, 84.2% similarity)<br>AGU13869.1 (77.7% identity, 83.8% similarity)<br>US20110203014_23 (77.7% identity, 83.8% similarity)<br>APG00056 (75.8% identity, 84.8% similarity)<br>APG00058 (66.6% identity, 76.7% similarity)<br>APG00469 (56.0% identity, 66.3% similarity)<br>Cry32Ca1 (55.5% identity, 65.4% similarity)<br>APG00504 (55.4% identity, 66.2% similarity)<br>APG00310 (53.0% identity, 63.8% similarity)<br>APG00068 (52.2% identity, 64.0% similarity)<br>APG00054 (51.6% identity, 61.7% similarity)<br>APG00105 (50.0% identity, 60.7% similarity) | Cry32 | 80, 85, 90, 95, 96, 97, 98, 99 | 85, 90, 95, 96, 97, 98, 99 |
| APG00431 | 56 | | | | APG00015 (60.6% identity, 77.3% similarity)<br>APG00468 (60.0% identity, 76.8% similarity)<br>Cyt2Aa2 (46.1% identity, 65.1% similarity) | Cyt2 | 50, 55, 60, 65, 70, 75, 80, 85, 90, 95, 96, 97, 98, 99 | 70, 75, 80, 85, 90, 95, 96, 97, 98, 99 |
| APG00433 | 57 | 174 | | | APG00382 (57.0% identity, 73.2% similarity)<br>APG00484 (56.4% identity, 73.2% similarity)<br>WP_003290257.1 (44.5% identity, 58.2% similarity)<br>WP_008180054.1 (44.2% identity, 62.7% similarity)<br>WP_000790613.1 (43.2% identity, 58.3% similarity)<br>WP_016099228.1 (42.9% identity, 61.7% similarity) | Mtx | 45, 50, 55, 60, 65, 70, 75, 80, 85, 90, 95, 96, 97, 98, 99 | 65, 70, 75, 80, 85, 90, 95, 96, 97, 98, 99 |
| APG00434 | 58 | | | | Cry64Aa1 (33.1% identity, 47.5% similarity) | Mtx | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00435 | 59 | | | | AGA40057.1 (36.6% identity, 53.5% similarity)<br>WP_017762581.1 (36.0% identity, 48.9% similarity)<br>AGP17992.1 (35.0% identity, 47.8% similarity)<br>AGA40058.1 (31.6% identity, 47.9% similarity) | Cry | 40, 45, 50, 55, 60, 65, 70, 75, 80, 85, 90, 95, 96, 97, 98, 99 | 55, 60, 65, 70, 75, 80, 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00436 | 60 | 61 | | | APG00599 (98.1% identity, 98.4% similarity)<br>APG00093 (50.5% identity, 63.1% similarity)<br>US_875619_B2-20 (42.0% identity, 55.7% similarity)<br>EJR95133.1 (27.1% identity, 35.2% similarity)<br>Cry32Ea1 (23.2% identity, 30.3% similarity) | Cry | 45, 50, 55, 60, 65, 70, 75, 80, 85, 90, 95, 96, 97, 98, 99 | 60, 65, 70, 75, 80, 85, 90, 95, 96, 97, 98, 99 |
| APG00437 | 62 | 175 | | | APG00126 (89.2% identity, 91.6% similarity)<br>WP_016110460.1 (84.0% identity, 89.2% similarity)<br>APG00177 (55.4% identity, 71.5% similarity)<br>APG00121 (55.0% identity, 69.1% similarity)<br>APG00128 (54.6% identity, 69.2% similarity)<br>WP_016110459.1 (53.5% identity, 68.5% similarity)<br>US_6686452-2 (38.1% identity, 53.3% similarity)<br>Cyt2Aa3 (37.8% identity, 53.0% similarity) | Cyt | 85, 90, 95, 96, 97, 98, 99 | 90, 95, 96, 97, 93, 99 |
| APG00438 | 63 | 176 | | | AGP17984.1 (41.4% identity, 59.6% similarity)<br>AGP18033.1 (39.8% identity, 57.2% similarity)<br>US_8829279_B2-11 (26.7% identity, 42.7% similarity)<br>AGS78124.1 (23.8% identity, 38.5% similarity) | Mtx | 45, 50, 55, 60, 65, 70, 75, 80, 85, 90, 95, 96, 97, 98, 99 | 60, 65, 70, 75, 80, 85, 90, 95, 96, 97, 98, 99 |
| APG00439 | 64 | 177 | | | APG00117 (72.0% identity, 73.3% similarity)<br>APG00186 (71.5% identity, 72.6% similarity)<br>APG00548 (61.4% identity, 62.9% similarity)<br>APG00138 (52.8% identity, 55.1% similarity)<br>AJF268767.1 (40.1% identity, 41.0% similarity)<br>WP_030689537.1 (39.5% identity, 40.4% similarity)<br>WP_030313032.1 (38.0% identity, 39.5% similarity)<br>Cyt2Aa2 (13.0% identity, 23.9% similarity) | Cyt | 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 |
| APG00440 | 65 | | | | AGA40039.1 (41.2% identity, 56.3% similarity)<br>WP_002191947.1 (40.2% identity, 55.8% similarity)<br>WP_002166959.1 (40.0% identity, 55.8% similarity)<br>Cry35Ac2 (25.9% identity, 38.8% similarity) | Bin | 45, 50, 55, 60, 65, 70, 75, 80, 85, 90, 95, 96, 97, 98, 99 | 60, 65, 70, 75, 80, 85, 90, 95, 96, 97, 98, 99 |
| APG00442 | 66 | 178, 179 | | | APG00032 (95.2% identity, 97.4% similarity)<br>WP_019419510.1 (41.3% identity, 55.5% similarity)<br>Cry70Ba1 (37.1% identity, 54.0% similarity) | Cry | 45, 50, 55, 60, 65, 70, 75, 80, 85, 90, 95, 96, 97, 98,99 | 60, 65, 70, 75, 80, 85, 90, 95, 96, 97, 98, 99 |

TABLE 1-continued

| Summary of SEQ ID NOs, Gene Class, and Variants thereof | | | | | | | | |
|---|---|---|---|---|---|---|---|---|
| Gene Name | Full-length SEQ ID No. | Mod-ified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
| APG00445 | 67 | 180 | | | WP_001227778.1 (28.4% identity, 47.2% similarity)<br>US20130227743A1_66 (27.0% identity, 45.8% similarity)<br>WP_018669999.1 (24.2% identity, 42.0% similarity)<br>WP_000671232 .1 (23.9% identity, 42.5% similarity) | Mtx | 30, 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00446 | 68 | 181 | | | APG00302 (58.7% identity, 71.8% similarity)<br>US20130227743A1_200 (27.9% identity, 45.7% similarity)<br>US_2013_0227743_A1_178 (26.3% identity, 41.5% similarity)<br>AGA40058.1 (25.3% identity, 38.4% similarity)<br>Cry42Aa1 (17.8% identity, 28.7% similarity) | Cry | 30, 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00447 | 69 | | | | WP_033728980.1 (64.0% identity, 69.1% similarity)<br>APG00338 (53.9% identity, 58.9% similarity)<br>ETT84678.1 (43.9% identity, 48.9% similarity)<br>WP_016124145.1 (35.0% identity, 45.5% similarity)<br>US_8829279_B2-9 (33.1% identity, 47.3% similarity) | PI-PLC | 65, 70, 75, 80, 85, 90, 95, 96, 97, 98, 99 | 70, 75, 80, 85, 90, 95, 96, 97, 98, 99 |
| APG00448 | 70 | 182 | | | WP_002166885.1 (84.8% identity, 88.4% similarity)<br>APG00020 (83.9% identity, 88.4% similarity)<br>APG00253 (80.1% identity, 85.4% similarity)<br>APG00764 (77.6% identity, 81.5% similarity)<br>APG00635 (75.7% identity, 81.5% similarity)<br>APG00268 (74.6% identity, 81.2% similarity)<br>US20130227743A1_110 (43.5% identity, 59.5% similarity)<br>AGP17985.1 (35.4% identity, 50.1% similarity)<br>AGP17983.1 (33.7% identity, 49.3% similarity) | Mtx | 85, 90, 95, 96, 97, 98, 99 | 90, 95, 96, 97, 98, 99 |
| APG00449 | 71 | | | | APG00191 (96.2% identity, 97.5% similarity)<br>APG00380 (84.3% identity, 91.1% similarity)<br>APG00413 (67.8% identity, 79.7% similarity)<br>KEZ80012.1 (67.5% identity, 79.4% similarity)<br>APG00230 (67.2% identity, 78.9% similarity)<br>APG00741 (63.4% identity, 75.9% similarity)<br>WP_017154552.1 (61.6% identity, 75.7% similarity)<br>APG00596 (59.8% identity, 74.7% similarity)<br>APG00482 (58.6% identity, 70.7% similarity) | Bin | 70, 75, 80, 85, 90, 95, 96, 97, 98, 99 | 80, 85, 90, 95, 96, 97, 98, 99 |

TABLE 1-continued

Summary of SEQ ID NOs, Gene Class, and Variants thereof

| Gene Name | Full-length SEQ ID No. | Mod-ified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | WP_903308586.1 (47.2% identity, 63.1% similarity)<br>Cry49Ab1 (19.8% identity, 32.3% similarity) | | | |
| APG00450 | 72 | 183 | | | Cry64Aa1 (88.5% identity, 92.8% similarity)<br>APG00501 (65.5% identity, 68.1% similarity) | Cry64A | 90, 95, 96, 97, 98, 99 | 95, 96, 97, 98, 99 |
| APG00452 | 73 | 184 | | | APG00196 (80.1% identity, 88.0% similarity)<br>APG00113 (80.0% identity, 88.5% similarity)<br>APG00030 (67.0% identity, 80.6% similarity)<br>APG00096 (63.6% identity, 78.5% similarity)<br>AGP17989.1 (63.2% identity, 79.0% similarity)<br>APG00114 (54.4% identity, 73.1% similarity)<br>AGP17990.1 (53.0% identity, 65.2% similarity)<br>US-2013_9227743A1_194 (38.4% identity, 45.5% similarity)<br>Cry42Aa1 (23.5% identity, 36.1% similarity) | Cry | 65, 70, 75, 80, 85, 90, 95, 96, 97, 98, 99 | 80, 85, 90, 95, 96, 97, 98, 99 |
| APG00458 | 74 | | | | WP_003343780.1 (92.9% identity, similarity)<br>AIG25814.1 (92.6% identity, 96.2% similarity)<br>WP_022584953.1 (92.4% identity, 95.9% similarity)<br>WP_018669999.1 (88.8% identity, 93.2% similarity) | Mtx | 95, 96, 97, 98, 99 | 97, 98, 99 |
| APG00460 | 75 | 185 | | | WP_017762619.1 (51.5% identity, 65.5% similarity)<br>US20130227743A1_206 (47.4% identity, 64.9% similarity)<br>WP_017762581.1 (29.7% identity, 44.0% similarity)<br>AGP17992.1 (28.3% identity, 43.5% similarity) | Cry | 55, 60, 65, 70, 75, 80, 85, 90, 95, 96, 97, 98, 99 | 60, 65, 70, 75, 80, 85, 90, 95, 96, 97, 98, 99 |
| APG00463 | 76 | 77 | | | AGU13875.1 (44.2% identity, 57.5% similarity)<br>US201400446281A1_12 (44.2% identity, 57.5% similarity)<br>AGU13832.1 (43.8% identity, 58.7% similarity)<br>Cry32Ea1 (40.6% identity, 56.0% similarity) | Cry | 45, 50, 55, 60, 65, 70, 75, 80, 85, 90, 95, 96, 97, 98, 99 | 60, 65, 70, 75, 80, 85, 90, 95, 96, 97, 98, 99 |
| APG00464 | 78 | | | | APG00017 (94.1% identity, 97.6% similarity)<br>APG00194 (57.4% identity, 71.3% similarity)<br>US_8513493_B2-47 (31.2% identity, 52.7% similarity)<br>Cyt2Ca1 (30.6% identity, 41.1% similarity) | Cyt | 35, 40, 45, 50, 55, 60, 65, 70, 75, 80, 85, 90, 95, 96, 97, 98, 99 | 55, 60, 65, 70, 75, 80, 85, 90, 95, 96, 97, 98, 99 |
| APG00465 | 79 | 186 | | | APG00250 (56.3% identity, 60.2% similarity)<br>APG00053 (56.3% identity, 60.0% similarity)<br>AGA40058.1 (17.6% identity, 29.3% similarity)<br>WP_017762581.1 (16.7% identity, 25.6% similarity) | Cry | 20, 25, 30, 35, 40, 45, 50, 55, 60, 65, 70, 75, 80, 85, 90, 95, 96, 97, 98, 99 | 30, 35, 40, 45, 50, 55, 60, 65, 70, 75, 80, 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | AGA40057.1 (16.2% identity, 26.4% similarity)<br>AGP17992.1 (16.2% identity, 25.7% similarity) | | | |
| APG00466 | 80 | 187 | | | WP_036654376.1 (38.6% identity, 55.1% similarity)<br>WP_000794513.1 (37.6% identity, 54.4% similarity)<br>ETK27180.1 (37.4% identity, 53.0% similarity)<br>AGP18071.1 (37.2% identity, 54.0% similarity) | Mtx | 40, 45, 50, 55, 60, 65, 70, 75, 80, 85, 90, 95, 96, 97, 98, 99 | 60, 65, 70, 75, 80, 85, 90, 95, 96, 97, 98, 99 |
| APG00468 | 81 | | | | APG00015 (96.7% identity, 98.5% similarity)<br>APG00168 (60.3% identity, 72.6% similarity)<br>APG00431 (60.0% identity, 76.8% similarity)<br>Cyt2Aa2 (53.0% identity, 67.3% similarity) | Cyt2 | 55, 60, 65, 70, 75, 80, 85, 90, 95, 96, 97, 98, 99 | 70, 75, 80, 85, 90, 95, 96, 97, 98, 99 |
| APG00469 | 82 | 83 | | | WP_029439076.1 (62.0% identity, 74.1% similarity)<br>Cry32Aa1 (60.8% identity, 71.8% similarity)<br>APG00310 (57.1% identity, 68.8% similarity)<br>APG00105 (56.3% identity, 68.3% similarity)<br>APG00430 (56.0% identity, 66.3% similarity)<br>APG00068 (55.4% identity, 68.8% similarity)<br>APG00054 (55.0% identity, 66.1% similarity)<br>APG00056 (54.6% identity, 66.1% similarity)<br>APG00504 (52.2% identity, 63.9% similarity) | Cry32 | 65, 70, 75, 80, 85, 90, 95, 96, 97, 98, 99 | 75, 80, 85, 90, 95, 96, 97, 98, 99 |
| APG00470 | 84 | 188 | | | US_8318900_B2-69 (27.1% identity, 38.1% similarity)<br>US20130227743A1_106 (25.9% identity, 39.2% similarity)<br>AGA40064.1 (25.0% identity, 35.2% similarity)<br>KEZ79637.1 (23 8% identity, 30.2% similarity) | Mtx | 30, 35, 40, 45, 50, 55, 60, 65, 70, 75, 80, 85, 90, 95, 96, 97, 98, 99 | 40, 45, 50, 55, 60, 65, 70, 75, 80, 85, 90, 95, 96, 97, 98, 99 |
| APG00471 | 85 | 189 | | | APG00232 (54.0% identity, 63.8% similarity)<br>US20130227743A1_200 (30.6% identity, 44.1% similarity)<br>AGA40057.1 (26.6% identity, 40.7% similarity)<br>WP_017762619.1 (26.5% identity, 39.2% similarity)<br>Cry73Aa (19.1% identity, 32.2% similarity) | Cry | 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 |
| APG00472 | 86 | | | | APG00642 (73.4% identity, 84.0% similarity)<br>WP_016093722.1 (31.7% identity, 46.8% similarity)<br>WP_033679178.1 (31.2% identity, 47.6% similarity)<br>WP_026900834.1 (30.4% identity, 45.5% similarity)<br>Cry35Aa2 (25.6% identity, 40.3% similarity) | Bin | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |

TABLE 1-continued

| Summary of SEQ ID NOs, Gene Class, and Variants thereof | | | | | | | | |
|---|---|---|---|---|---|---|---|---|
| Gene Name | Full-length SEQ ID No. | Mod-ified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
| APG00473 | 87 | 88, 190, 191 | | | Cry21Aa2 (28.1% identity, 43.9% similarity) | Cry | 30, 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 |
| APG00474 | 89 | 192 | | | APG00629 (55.1% identity, 64.2% similarity)<br>3WA1A (31.71 identity, 45.0% similarity)<br>Cry49Aa1 (29.3% identity, 42.5% similarity) | Bin | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00475 | 90 | 193 | | | APG00269 (96.5% identity, 98.1% similarity)<br>APG00560 (95.4% identity, 97.0% similarity)<br>APG00995 (83.6% identity, 89.5% similarity)<br>APG00414 (82.6% identity, 89.0% similarity)<br>APG00593 (82.6% identity, 88.7% similarity)<br>US20130227743A1_110 (52.5% identity, 67.9% similarity)<br>AGP17985.1 (46.6% identity, 59.2% similarity)<br>WP_002166885.1 (43.9% identity, 59.4% similarity)<br>AGP17983.1 (43.1% identity, 60.0% similarity) | Mtx | 55, 60, 65, 70, 75, 80, 85, 90, 95, 96, 97, 98, 99 | 70, 75, 80, 85, 90, 95, 96, 97, 98, 99 |
| APG00476 | 91 | 194 | | | APG00174 (97.1% identity, 99.2% similarity)<br>WP_000875422.1 (75.1% identity, 84.5% similarity)<br>WP_000875423.1 (74.8% identity, 85.0% similarity)<br>APG00406 (74.7% identity, 83.1% similarity)<br>WP_003275939.1 (73.8% identity, 83.9% similarity)<br>WP_000797173.1 (71.5% identity, 82.2% similarity)<br>APG00055 (71.1% identity, 81.2% similarity)<br>APG00768 (60.9% identity, 75.3% similarity)<br>APG00064 (60.3% identity, 75.1% similarity) | Mtx | 80, 85, 90, 95, 96, 97, 98, 99 | 90, 95, 96, 97, 98, 99 |
| APG00478 | 92 | | 93 | | US20100137216A1_2 (53.9% identity, 68.7% similarity)<br>WP_001063906.1 (53.8% identity, 71.1% similarity)<br>ETT84679.1 (34.5% identity, 49.1% similarity)<br>Cry18Aa1 (30.9% identity, 45.9% similarity) | Cry | 55, 60, 65, 70, 75, 80, 85, 90, 95, 96, 97, 98, 99 | 75, 80, 85, 90, 95, 96, 97, 98, 99 |
| APG00482 | 94 | 195 | | | APG00757 (98.5% identity, 98.5% similarity)<br>APG00741 (90.1% identity, 90.9% similarity)<br>APG00060 (70.6% identity, 70.6% similarity)<br>WP_017154552.1 (67.8% identity, 76.1% similarity)<br>APG00596 (65.7% identity, 74.8% similarity)<br>KEZ80012.1 (62.7% dually, 72.1% similarity) | Bin | 70, 75, 80, 85, 90, 95, 96, 97, 98, 99 | 80, 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | APG00230 (61.6% identity, 73.1% similarity)<br>APG00449 (58.6% identity, 70.7% similarity)<br>APG00380 (57.0% identity, 68.5% similarity)<br>WP_003308586.1 (49.3% identity, 63.1% similarity)<br>Cry49Aa1 (21.3% identity, 32.6% similarity) | | | |
| APG00487 | 95 | | | | Cyt1Aa6 (20.9% identity, 40.1% similarity) | Cyt | 25, 30, 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 |
| APG00501 | 96 | 196 | | | APG00450 (65.5% identity, 68.1% similarity)<br>Cry64Aa1 (64.6% identity, 68.8% similarity) | Cry64 | 65, 70, 75, 80, 85, 90, 95, 96, 97, 98, 99 | 70, 75, 80, 85, 90, 95, 96, 97, 98, 99 |
| APG00502 | 97 | | | | APG00391 (93.5% identity, 96.7% similarity)<br>APG00267 (91.9% identity, 93.6% similarity)<br>US20130227743A1_200 (30.2% identity, 47.9% similarity)<br>AGA40058.1 (28.5% identity, 45.8% similarity)<br>WP_017762581.1 (25.7% identity, 40.5% similarity)<br>AGP17992.1 (25.2% identity, 38.5% similarity) | Cry | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00503 | 98 | | | | APG00720 (98.3% identity, 99.0% similarity)<br>WP_001072414.1 (88.2% identity, 93.7% similarity)<br>WP_002187783.1 (86.8% identity, 93.4% similarity)<br>WP_002144454.1 (86.1% identity, 93.7% similarity)<br>APG00381 (79.8% identity, 89.9% similarity)<br>APG00397 (79.1% identity, 88.9% similarity)<br>APG00519 (78.4% identity, 87.1% similarity)<br>WP_002169785.1 (66.3% identity, 78.7% similarity)<br>APG00265 (51.6% identity, 74.4% similarity) | Cry6 | 90, 95, 96, 97, 98, 99 | 95, 96, 97, 98, 99 |
| APG00504 | 99 | 100 | | | AGU13820.1 (56.6% identity, 67.1% similarity)<br>APG00056 (55.5% identity, 66.6 similarity)<br>APG00430 (55.4% identity, 66.2% similarity)<br>Cryn32Ea1 (54.1% identity, 64.2% similarity)<br>APG00068 (52.6% identity, 64.9% similarity)<br>APG00469 (52.2% identity, 63.7% similarity)<br>APG00058 (51.5% identity, 62.4% similarity)<br>APG00310 (51.2% identity, 62.1% similarity) | Cry32 | 60, 65, 70, 75, 80, 85, 90, 95, 96, 97, 98, 99 | 70, 75, 80, 85, 90, 95, 96, 97, 98, 99 |
| APG00505 | 101 | 197 | | | AGA40042.1 (80.3% identity, 87.2% similarity) | Mtx | 85, 90, 95, 96, 97, 98, 99 | 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | AGA40043.1 (74.1% identity, 83% similarity)<br>APG00339 (61.2% identity, 72.9% similarity)<br>AGP17985.1 (26.5% identity, 44.0% similarity)<br>WP_000844424.1 (26.5% identity, 43.9% similarity) | | | |
| APG00506 | 102 | 198 | | | AGT29560.1 (49.5% identily, 68.7% similarity)<br>AGT29559.1 (43.0% identity, 66.9% similarity)<br>Cry64Aa1 (39.7% identity, 61.8% similarity) | Mtx | 50, 55, 60, 65, 70, 75, 80, 85, 90, 95, 96, 97, 98, 99 | 70, 75, 80, 85, 90, 95, 96, 97, 98, 99 |
| APG00507 | 103 | 199 | | | WP_012291794.1 (93.8% identity, 97.6% similarity)<br>WP_036161900.1 (92.6% identity, 96.1% similarity)<br>WP_036165212.1 (92.0% identity, 95.5% similarity)<br>APG00561 (50.9% identity, 67.7% similarity)<br>WP_019419941.1 (50.6% identity, 68.3% similarity) | Mtx | 95, 96, 97, 98, 99 | 98, 99 |
| APG00518 | 105 | 105, 200, 201 | | 106 | AGV55019.1 (45.4% identity, 51.3% similarity)<br>ACR88315.1 (37.3% identity, 45.8% similarity)<br>Cry56Aa1 (37.0% identity, 46.2% similarity) | Cry | 50, 55, 60, 65, 70, 75, 80, 85, 90, 95, 96, 97, 98, 99 | 55, 60, 65, 70, 75, 80, 85, 90, 95, 96, 97, 98, 99 |
| APG00548 | 107 | 202 | | | APG00138 (75.1% ideally, 78.3% similarity)<br>APG00108 (63.1% identity, 66.5% similarity)<br>APG00439 (61.4% identity, 62.9% similarity)<br>AJF68767.1 (57.6% identity, 58.9% similarity)<br>WP_030689537.1 (57.5% identity, 58.5% similarity)<br>APG00134 (54.7% identity, 57.6% similarity)<br>WP_015038174.1 (54.1% identity, 57.6% similarity)<br>Cyt2Ca1 (18.2% identity, 30.8% similarity) | Cyt | 60, 65, 70, 75, 80, 85, 90, 95, 96, 97, 98, 99 | 60, 65, 70, 75, 80, 85, 90, 95, 96, 97, 98, 99 |
| APG00549 | 108 | 203 | | | WP_015345272.1 (28.0% identity, 45.2% similarity)<br>WP_016110619.1 (22.1% identity, 40.2% similarity)<br>WP_001072414.1 (21.1% identity, 38.7% similarity) | Cry6 | 30, 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00551 | 109 | 204 | | | US20130227743A1_22 (66.8% identity, 38.7% similarity)<br>APG00592 (60.0% identity, 63.7% similarity)<br>APG00300 (57.2% identity, 62.8% similarity)<br>US20130227743A1_146 (56.2% identity, 62.8% similarity)<br>APG00212 (55.7% identity, 60.8% similarity)<br>APG00619 (52.8% identity, 60.7% similarity)<br>APG00798 (51.9% identity, 58.5% similarity) | Bin | 70, 75, 80, 85, 90, 95, 96, 97, 98, 99 | 75, 80, 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | WP_002166959.1 (51.8% identity, 60.2% similarity)<br>APG00306 (50.9% identity, 60.2% similarity)<br>Cry35Ac2 (19.9% identity, 37.0% similarity) | | | |
| APG00552 | 110 | 205 | | | WP_016078640.1 (59.3% identity, 76.0% similarity)<br>APG00633 (56.9% identity, 71.7% similarity)<br>APG00244 (56.5% identity, 73.3% similarity)<br>APG00541 (55.6% identity, 73.3% similarity)<br>APG00509 (55.0% identity, 72.6% similarity)<br>APG00362 (54.8% identity, 73.5% similarity)<br>WP_033699741.1 (52.0% identity, 65.1% similarity)<br>APG00896 (51.7% identity, 66.6% similarity)<br>WP_036146575.1 (50.4% identity; 64.3% similarity)<br>WP_036654376.1 (49.7% identity, 64.0% similarity) | Mtx | 60, 65, 70, 75, 80, 85, 90, 95, 96, 97, 98, 99 | 80, 85, 90, 95, 96, 97, 98, 99 |
| APG00561 | 111 | 206 | | | WP_006675070.1 (93.5% identity, 97.6% similarity)<br>WP_019419941.1 (82.5% identity, 92.9% similarity)<br>WP_006285803.1 (77.5 identity, 87.3% similarity)<br>WP_036161900.1 (50.9% identity, 68.3% similarity)<br>APG00507 (50.9% identity, 67.7% similarity) | Mtx | 95, 96, 97, 98, 99 | 98, 99 |
| APG00582 | 112 | 113, 207 | | | EP_1947184-8.01 (31.7% identity; 44.3% similarity)<br>US_8461421_B2-120 (31.0% identity, 45.2% similarity)<br>US_8318900_B2-56 (28.7% identity, 44.1% similarity)<br>Cry4Cb1 (21.8% identity, 30.3% similarity) | Cry | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00583 | 114 | | | | WP_002193629.1 (45.7% identity, 59.8% similarity)<br>AGA40032.1 (25.1% identity, 38.9% similarity)<br>US20120278954A1_54 (23.4% identity, 42.1% similarity)<br>WP_011254649.1 (22.2% identity, 41.8% similarity) | Mtx | 50, 55, 60, 65, 70, 75, 80, 85, 90, 95, 96, 97, 98, 99 | 60, 65, 70, 75, 80, 85, 90, 95, 96, 97, 98, 99 |
| APG00584 | 115 | | | | WP_015345272.1 (24.0% identity, 46.6% similarity) | Cry6 | 25, 30, 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00585 | 116 | 208 | | | WP_018673409.1 (88.7% identity, 94.2% similarity)<br>APG00851 (81.9% identity, 88.7% similarity)<br>APG00427 (81.3% identity, 88.0% similarity)<br>WP_001039209.1 (70.0% identity, 80.0% similarity)<br>APG00309 (62.1% identity, 76.3% similarity) | Mtx | 90, 95, 96, 97, 98, 99 | 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| | | | | | US_8829279_B2-61 (56.2% identity, 71.7% similarity)<br>US_8829279_B2-2 (55.3% identity, 70.8% similarity) | | | |
| APG00599 | 117 | | | | APG00436 (98.1% identity, 98.4% similarity)<br>APG00093 (51.5% identity, 63.5% similarity)<br>US_8759619_B2-20 (42.9% identity, 56.9% similarity)<br>EJR95133.1 (27.0% identity, 35.2% similarity)<br>Cry32Ea1 (23.2% identity, 30.5% similarity) | Cry | 45, 50, 55, 60, 65, 70, 75, 80, 85, 90, 95, 96, 97, 98, 99 | 60, 65, 70, 75, 80, 85, 90, 95, 96, 97, 98, 99 |
| APG00602 | 118 | 209 | | | APG00731 (89.5% identity, 93.0% similarity)<br>APG00035 (86.3% identity, 92.0% similarity)<br>APG00231 (86.3% identity, 91.2% similarity)<br>WP_000143307.1 (86.1% identity, 91.4% similarity)<br>APG00356 (86.1% identity, 91.2% similarity)<br>APG00377 (85.8% identity, 90.3% similarity)<br>WP_000143308.1 (84.7% identity, 90.3% similarity)<br>US20130227743A1_6 (84.7% identity, 87.1% similarity)<br>Cry35Ac2 (21.1% identity, 40.8% similarity) | Bin | 90, 95, 96, 97, 98, 99 | 95, 96, 97, 98, 99 |
| APG00615 | 119 | 210 | | | APG00372 (96.6% identity, 98.2% similarity)<br>WP_017762581.1 (36.4% identity, 46.0% similarity)<br>AGP17992.1 (36.2% identity, 46.5% similarity)<br>AGA40058.1 (31.7% identity, 47.7% similarity)<br>WP_017762619.1 ( 30.6% identity, 44.4% similarity) | Cry | 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00616 | 120 | | | | WP_000282613.1 (87.6% identity, 92.0% similarity)<br>AGP18066.1 (38.4% identity, 53.1% similarity)<br>US_2013_0227743_A1_196 (30.5% identity, 47.3% similarity)<br>Cry2Ah3 (26.6% identity, 42.8% similarity) | Cry | 90, 95, 96, 97, 98, 99 | 95, 96, 97, 98, 99 |
| APG00617 | 121 | 122, 211, 212 | | | AGP18032.1 (32.5% identity, 46.1% similarity)<br>Cry21Ca2 (26.0% identity, 37.6% similarity) | Cry | 35, 40, 45, 50, 55, 60, 65, 70, 75, 80, 85, 90, 95, 96, 97, 98, 99 | 50, 55, 60, 65, 70, 75, 80, 85, 90, 95, 96, 97, 98, 99 |
| APG00618 | 123 | | | | AGP18066.1 (88.0% idenity, 92.8% similarity)<br>WP_000282613.1 (40.0% identity, 55.7% similarity)<br>ETT84679.1 (33.1% identity, 51.1% similarity)<br>Cry2Ae1 (29.5% identity, 46.9% similarity) | Cry | 90, 95, 96, 97, 98, 99 | 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00626 | 124 | 213, 214 | | | WP_017762619.1 (35.7% identity, 50.0% similarity)<br>AGA40057.1 (33.0% identity, 48.2% similarity)<br>US20130227743A1_206 (31.3% identity, 46.2% similarity)<br>WP_017762581.1 (30.1% identity, 45.1% similarity) | Cry | 40, 45, 50, 55, 60, 65, 70, 75, 80, 85, 90, 95, 96, 97, 98, 99 | 55, 60, 65, 70, 75, 80, 85, 90, 95, 96, 97, 98, 99 |
| APG00627 | 125 | | | | WP_001104853.1 (69.3% identity, 82.4% similarity)<br>WP_002187785.1 (69.0% identity, 83.1% similarity)<br>WP_016078425.1 (68.3% identity, 82.1% similarity)<br>APG00291 (67.5% identity, 79.7% similarity)<br>WP_001104975.1 (67.2% identity, 81.0% similarity)<br>APG00265 (66.4% identity, 79.6% similarity)<br>APG00280 (52.9% identity, 67.5% similarity)<br>APG00381 (52.2% identity, 71.3% similarity)<br>APG00397 (50.9% identity, 69.2% similarity) | Cry6 | 70, 75, 80, 85, 90, 95, 96, 97, 98, 99 | 85, 90, 95, 96, 97, 98, 99 |
| APG00629 | 126 | | | | APG00474 (55.1% identity, 64.2% similarity)<br>Cry49Aa1 (30.0% identity, 43.8% similarity)<br>US_7692068_B2-2 (30.0% identity, 39.1% similarity) | Bin | 35, 40, 45, 50, 55, 60, 65, 70, 75, 80, 85, 90, 95, 96, 97, 98, 99 | 45, 50, 55, 60, 65, 70, 75, 80, 85, 90, 95, 96, 97, 98, 99 |
| APG00631 | 127 | | | | WP_000240777.1 (95.2% identity, 98.6% similarity)<br>WP_000240776.1 (94.9% identity, 98.6% similarity)<br>WP_000240775.1 (94.6% identity, 98.3% similarity)<br>APG00024 (92.2% identity, 95.8% similarity)<br>APG00180 (77.6% identity, 91.5% similarity)<br>APG00432 (71.7% identity, 85.8% similarity)<br>APG00312 (65.7% identity, 81.9% similarity)<br>APG00342 (65.7% identity, 81.6% similarity)<br>APG00951 (65.4% identity, 82.2% similarity)<br>Cry6Ba1 (27.8% identity, 47.4% similarity) | Cry6 | 96, 97, 98, 99 | 99 |
| APG00632 | 128 | 129, 215 | | | AGU13825.1 (79.5% identity, 87.9% similarity)<br>Cry2Aa13 (79.5% identity, 87.8% similarity)<br>A1E37446.1 (79.5% identity, 87.8% similarity) | Cry2A | 80, 85, 90, 95, 96, 97,98, 99 | 90, 95, 96, 97, 98, 99 |
| APG00699 | 130 | 216 | | | WP_002090290.1 (72.9% identity, 82.4% similarity)<br>WP_003206808.1 (49.5% identity, 68.7% similarity)<br>WP_003196831.1 (49.2% identity, 68.7% similarity)<br>WP_018765384.1 (49.2% identity, 68.7% similarity) | Cry6 | 75, 80, 85, 90, 95, 96, 97, 98, 99 | 85, 90, 95, 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00734 | 131 | 217 | | | Cry36Aa1 (36.3% identity, 50.6% similarity) | Bin | 40, 45, 50, 55, 60, 65, 70, 75, 80, 85, 90, 95, 96, 97, 98, 99 | 55, 60, 65, 70, 75, 80, 85, 90, 95, 96, 97, 98, 99 |
| APG00750 | 132 | 218 | | | US_7692068_B2-2 (42.6% identity, 57.4% similarity)<br>Cry49Ab1 (39.6% identity, 53.9% similarity) | Bin | 45, 50, 55, 60, 65, 70, 75, 80, 85, 90, 95, 96, 97, 98, 99 | 60, 65, 70, 75, 80, 85, 90, 95, 96, 97, 98,99 |
| APG00875 | 133 | 219 | | | APG00173 (94.2% identity, 96.6% similarity)<br>APG00278 (93.5% identity, 96.0% similarity)<br>APG00358 (85.3% identity, 90.1% similarity)<br>APG00077 (81.9% identity, 87.3% similarity)<br>APG00175 (79.6% identity, 85.4% similarity)<br>KEZ80024.1 (75.0% identity, 84.5% similarity)<br>APG00104 (70.5% identity, 78.9% similarity)<br>Vip3Af1 (24.9% identity, 42.5% similarity) | Vip3 | 80, 85, 90, 95, 96, 97, 98, 99 | 85, 90, 95, 96, 97, 98, 99 |
| APG00880 | 134 | | | | WP_016093722.1 (67.9% identity, 79.2% similarity)<br>APG00215 (67.2% identity, 77.4% similarity)<br>APG00386 (61.0% identity, 73.8% similarity)<br>WP_002167240.1 (59.9% identity, 72.9% similarity)<br>WP_002090518.1 (52.2% identity, 65.8% similarity)<br>Cry35Ad2 (24.9% identity, 42.8% similarity) | Bin | 70, 75, 80, 85, 90, 95, 96, 97, 98, 99 | 80, 85, 90, 95, 96, 97, 98, 99 |
| APG00900 | 135 | 220 | | | WP_016115095.1 (85,3% identity, 93.3% similarity)<br>WP_035436216.1 (82.7% identity, 91.5% similarity)<br>WP_026592789.1 (79.5% identity, 87.7% similarity)<br>WP_002109957.1 (78.1% identity, 86.9% similarity)<br>APG00209 (65.4% identity, 78.1% similarity) | Cry6 | 90, 95, 96, 97, 98, 99 | 95, 96, 97, 98, 99 |
| APG00951 | 136 | | | | APG00312 (95.5% identity, 96.3% similarity)<br>APG00342 (90.9% identity, 95.2% similarity)<br>WP_002144456.1 (90.4% identity, 95.8% similarity)<br>WP_002169783.1 (85.8% identity, 92.6% similarity)<br>APG00432 (73.1% identity, 85.8% similarity)<br>WP_000240777.1 (68.0% identity, 82.7% similarity)<br>APG00024 (65.5% identity, 81.3% similarity)<br>APG00631 (65.4% identity, 82.2% similarity)<br>APG00180 (62.3% identity, 78.2% similarity)<br>Cry6Ba1 (27.2% identity, 45.8% similarity) | Cry6 | 95, 96, 97, 98, 99 | 96, 97, 98, 99 |

TABLE 1-continued

Summary of SEQ ID NOs, Gene Class, and Variants thereof

| Gene Name | Full-length SEQ ID No. | Modified SEQ ID No(s). | CryBP1 SEQ ID No. | Split-Cry C-terminus SEQ ID No. | Homologs | Gene Class | Polypeptides of the invention (and polynucleotides encoding the same) include those having the % sequence identity listed below | Polypeptides of the invention (and polynucleotides encoding the same) include those having the similarity set forth below |
|---|---|---|---|---|---|---|---|---|
| APG00975 | 137 | 221 | | | KEZ80024.1 (15.4% identity, 19.6% similarity)<br>Vip3Ag2 (11.4 identity, 19.2% similarity) | Vip3 | 20, 25, 30, 35, 40, 45, 50, 55, 60, 65, 70, 75, 80, 85, 90, 95, 96, 97, 98, 99 | 20, 25, 30, 35, 40, 45, 50, 55, 60, 65, 70, 75, 80, 85, 90, 95, 96, 97, 98, 99 |
| APG00697 | 222 | | | | APG00346 (97.6% identity, 99.0% similarity)<br>US_8461415_B2-56 (54.5% identity, 68.5% similarity)<br>APG00987 (48.2% identity, 68.2% similarity)<br>APG00506 (45.9% identity, 66.9% similarity)<br>US_8461415_B2-57 (45.8% identity, 60.9% similarity)<br>APG00450 (42.0% identity, 57.3% similarity)<br>Cry64Aa1 (41.4% identity, 59.9% similarity) | Mtx | 55, 60, 65, 70, 75, 80, 85, 90, 95, 96, 97, 98, 99 | 70, 75, 80, 85, 90, 95, 96, 97, 98, 99 |
| APG00987 | 223 | 224 | | | APG00506 (93.0% identity, 96.0% similarity)<br>US_8461415_B2-57 (51.8% identity, 70.4% similarity)<br>APG00697 (48.2% identity, 68.2% similarity)<br>APG00316 (47.8% identity, 68.2% similarity)<br>US_8461415_B2-56 (44.6% identity, 67.9% similarity)<br>APG00450 (43.7% identity, 64.3% similarity)<br>Cry64Aa1 (41.2% identity, 63.0% similarity) | Mtx | 55, 60, 65, 70, 75, 80, 85, 90, 95, 96, 97, 98, 99 | 75, 80, 85, 90, 95, 96, 97, 98, 99 |

i. Classes of Pesticidal Proteins

The pesticidal proteins provided herein and the nucleotide sequences encoding them are useful in methods for impacting pests. That is, the compositions and methods of the invention find use in agriculture for controlling or killing pests, including pests of many crop plants. The pesticidal proteins provided herein are toxin proteins from bacteria and exhibit activity against certain pests. The pesticidal proteins are from several classes of toxins including Cry, Cyt, BIN, Mtx toxins. See, for example, Table 1 for the specific protein classifications of the various SEQ ID NOS provided herein. In addition, reference is made throughout this disclosure to Pfam database entries. The Pfam database is a database of protein families, each represented by multiple sequence alignments and a profile hidden Markov model. Finn et al. (2014) *Nucl. Acid Res. Database Issue* 42:D222-D230.

*Bacillus thuringiensis* (Bt) is a gram-positive bacterium that produces insecticidal proteins as crystal inclusions during its sporulation phase of growth. The proteinaceous inclusions of *Bacillus thuringiensis* (Bt) are called crystal proteins or δ-endotoxins (or Cry proteins), which are toxic to members of the class Insecta and other invertebrates. Similarly, Cyt proteins are parasporal inclusion proteins from Bt that exhibit hemolytic (cytolitic) activity or has obvious sequence similarity to a known Cyt protein. These toxins are highly specific to their target organism, are innocuous to humans, vertebrates, and plants.

The structure of the Cry toxins reveals five conserved amino acid blocks, concentrated mainly in the center of the domain or at the junction between the domains. The Cry toxin consists of three domains, each with a specific function. Domain I is a seven α-helix bundle in which a central helix is completely surrounded by six outer helices. This domain is implicated in channel formation in the membrane. Domain II appears as a triangular column of three anti-parallel β-sheets, which are similar to antigen-binding regions of immunoglobulins. Domain III contains anti-parallel β-strands in a β sandwich form. The N-terminal part of the toxin protein is responsible for its toxicity and specificity and contains five conserved regions. The C-terminal part is usually highly conserved and probably responsible for crystal formation. See, for example, U.S. Pat. No. 8,878,007.

Strains of *B. thuringiensis* show a wide range of specificity against different insect orders (Lepidoptera, Diptera, Coleoptera, Hymenoptera, Homoptera, Phthiraptera such as Mallophaga, and Acari) and other invertebrates (Nemathelminthes, Platyhelminthes, and Sarocomastebrates). The cry proteins have been classified into groups based on toxicity to various insect and invertebrate groups. Generally, Cry I demonstrates toxicity to lepidopterans, Cry II to lepidopterans and dipterans, CryIII to coleopterans, Cry IV to dipterans, and Cry V and Cry VI to nematodes. New Cry proteins can be identified and assigned to a Cry group based on amino acid identity. See, for example, Bravo, A. (1997) *J. of Bacteriol.* 179:2793-2801; Bravo et al. (2013) *Microb. Biotechnol.* 6:17-26, herein incorporated by reference.

Over 750 different cry gene sequences have been classified into 73 groups (Cry1-Cry73), with new members of this gene family continuing to be discovered (Crickmore el al. (2014) www.btnomenclature.info/). The cry gene family consists of several phylogentically non-related protein families that may have different modes of action: the family of three-domain Cry toxins, the family of mosquitocidal Cry toxins, the family of the binary-like toxins, and the Cyt family of toxins (Bravo et al., 2005). Some Bt strains produce additional insecticidal toxins, the VIP toxins. See, also, Cohen et al. (2011) *J. Mol. Biol.* 413:4-814; Crickmore et al. (2014) *Bacillus thuringiensis* toxin nomenclature, found on the world wide web at lifesci.sussex.ac.uk/home/Neil_Crickmore/Bt/; Crickmore et al. (1988)*Microbiol. Mol. Biol. Rev.* 62: 807-813; Gill et al. (1992) *Ani. Rev. Entomol.* 37: 807-636; Goldbert et al. (1997) *Appl. Environ. Microbiol.* 63:2716-2712; Knowles et al. (1992) *Proc. R. Soc. Ser. B.* 248: 1-7; Koni et al. (1994) *Microbiology* 140: 1869-1880; Lailak et al. (2013) *Biochem. Biophys. Res. Commun.* 435: 216-221; Lopez-Diaz el al. (2013) *Environ. Microbiol.* 15: 3030-3039; Perez et al. (2007) *Cell. Microbiol.* 9: 2931-2937; Promdonkoy et al. (2003) *Biochem. J.* 374: 255-259; Rigden (2009) *FEBS Lett.* 583: 1555-1560; Schnepf et al. (1998)*Microbiol. Mol. Biol. Rev.* 62: 775-806; Soberon et al. (2013) *Peptides* 41: 87-93; Thiery et al. (1998) *J. Am. Mosq. Control Assoc.* 14: 472-476; Thomas et al. (1983) FEBS Lett. 154: 362-368; Wirth et al. (1997) *Proc. Natl. Acad. Sci.* U.S.A. 94: 10536-10540; Wirth et al (2005) *Appl. Environ. Microbiol.* 71: 185-189; and, Zhang et al. (2006) *Biosci. Biotechnol. Biochem.* 70: 2199-2204; each of which is herein incorporated by reference in their entirety.

Cyt designates a parasporal crystal inclusion protein from *Bacillus thuringiensis* with cytolytic activity, or a protein with sequence similarity to a known Cyt protein. (Crickmore el al. (1998) *Microbiol. Mol. Biol. Rev.* 62: 807-813.) The gene is denoted by cyt. These proteins are different in structure and activity from Cry proteins (Gill et al. (1992) *Annu. Rev. Entomol.* 37: 615-636). The Cyt toxins were first discovered in *B. thuringiensis* subspecies *israelensis* (Goldberg et al. (1977) *Mosq. News.* 37: 355-358). There are 3 Cyt toxin families including 11 holotype toxins in the current nomenclature (Crickmore et al. (2014) *Bacillus thuringiensis* toxin nomenclature found on the world wide web at lifesci.sussex.ac.uk/home/Neil_Crickmore/Bt/). The majority of the *B. thuringiensis* isolates with cyt genes show activity against dipteran insects (particularly mosquitoes and black flies), but there are also cyt genes that have been described in *B. thuringiensis* strains targeting lepidopteran or coleopteran insects (Guerchicoff et al. (1997) *Appl. Environ. Microbiol.* 63: 2716-2721).

The structure of Cyt2A, solved by X-ray crystallography, shows a single domain where two outer layers of α-helix wrap around a mixed β-sheet. Further available crystal structures of Cyt toxins support a conserved α-β structural model with two α-helix hairpins flanking a β-sheet core containing seven to eight β-strands. (Cohen et al. (2011) *J. Mol. Biol.* 413: 80 4-814.) Mutagenic studies identified β-sheet residues as critical for toxicity, while mutations in the helical domains did not affect toxicity (Adang et al., Diversity of *Bacillus thuringiensis* Crystal Toxins and Mechanism of Action. In: T. S. Dhadialla and S. S. Gill, eds, *Advances in Insect Physiology, Vol.* 47, Oxford: Academic Press, 2014, pp. 39-87.) The representative domain of the Cyt toxin is a δ-endotoxin, Bac_thur_toxin (Pfam PF01338).

There are multiple proposed models for the mode of action of Cyt toxins, and it is still an area of active investigation. Some Cyt proteins (Cyt1A) have been shown to require the presence of accessory proteins for crystallization. Cyt1A and Cyt2A protoxins are processed by digestive proteases at the same sites in the N- and C-termini to a stable toxin core. Cyt toxins then interact with non-saturated membrane lipids, such as phosphatidylcholine, phosphatidylethanolamine, and sphingomyelin. For Cyt toxins, pore-formation and detergent-like membrane disruption have been proposed as non-exclusive mechanisms; and it is generally accepted that both may occur depending on toxin concentration, with lower concentrations favoring oligomeric pores and higher concentrations leading to membrane breaks. (Butko (2003) *Appl. Environ. Microbiol.* 69: 2415-2422) In the pore-formation model, the Cyt toxin binds to the cell membrane, inducing the formation of cation-selective channels in the membrane vesicles leading to colloid-osmotic lysis of the cell. (Knowles el al. (1989) FEBS Lett. 244: 259-262; Knowles et al. (1992) *Proc. R. Soc. Ser. B.* 248: 1-7 and Promdonkoy et al. (2003) *Biochem. J.* 374: 255-259.) In the detergent model, there is a nonspecific aggregation of the toxin on the surface of the lipid bilayer leading to membrane disassembly and cell death. (Butko (2003) supra; Manceva et al. (2005) *Biochem.* 44: 589-597.)

Multiple studies have shown synergistic activity between Cyt toxins and other *B. thuringiensis* toxins, particularly the Cry, Bin, and Mtx toxins. This synergism has even been shown to overcome an insect's resistance to the other toxin. (Wirth 1997, Wirth 2005, Thiery 1998, Zhang 2006.) The Cyt synergistic effect for Cry toxins is proposed to involve Cyt1A binding to domain II of Cry toxins in solution or on the membrane plane to promote formation of a Cry toxin pre-pore oligomer. Formation of this oligomer is independent of the Cyt oligomerization, binding or insertion. (Lailak 2013, Perez 2007, Lopez-Diaz 2013.)

A number of pesticidal proteins unrelated to the Cry proteins are produced by some strains of *B. thuringiensis* and *B. cereus* during vegetative growth (Estruch et al. (1996) *Proc Natl Acad Sci USA* 93:5389-5394; Warren et al. (1994) WO 94/21795). These vegetative insecticidal proteins, or Vips, do not form parasporal crystal proteins and are apparently secreted from the cell. The Vips are presently excluded from the Cry protein nomenclature because they are not crystal-forming proteins. The term VIP is a misnomer in the sense that some *B. thuringiensis* Cry proteins are also produced during vegetative growth as well as during the stationary and sporulation phases, most notably Cry3Aa. The location of the Vip genes in the *B. thuringiensis* genome has been reported to reside on large plasmids that also encode cry genes (Mesrati et al. (2005) *FEMS Microbiol. Lett.* 244(2):353-358.) A web-site for the nomenclature of Bt toxins can be found on the world wide web at lifesci.sussex.ac.uk with the path "/home/Neil_Crickmore/Bt/" and at: "btnomenclature.info/". See also, Schnepf et al. (1998) *Microbiol. Mol. Biol. Rev.* 62(3):775-806. Such references are herein incorporated by reference.

To date four categories of Vips have been identified. Some Vip genes form binary two-component protein complexes; an "A" component is usually the "active" portion, and a "B" component is usually the "binding" portion. (Pfam pfam.xfam.org/family/PF03495.) The Vip1 and Vip4 proteins generally contain binary toxin B protein domains. Vip2 proteins generally contain binary toxin A protein domains.

The Vip1 and Vip2 proteins are the two components of a binary toxin that exhibits toxicity to coleopterans. Vip1Aa1 and Vip2Aa1 are very active against corn rootwornms, particularly *Diabrotica virgifera* and *Diabrotica longicornis* (Han et al. (1999) *Nat. Struct. Biol.* 6:932-936; Warren G W (1997) "Vegetative insecticidal proteins: novel proteins for control of corn pests" In: Carozzi N B, Koziel M (eds) *Advances in insect control, the role of transgenic plants*; Taylor & Francis Ltd, London, pp 109-121). The membrane-binding 95 kDa Vip1 multimer provides a pathway for the 52 kDa vip2 ADP-ribosylase to enter the cytoplasm of target western corn rootworm cells (Warren (1997) supra). The NAD-dependent ADP-ribosyltransferase Vip2 likely modifies monomeric actin at Arg177 to block polymerization, leading to loss of the actin cytoskeleton and eventual cell death due to the rapid subunit ex-change within actin filaments in vivo (Carlier M. F. (1990) *Adv. Biophys.* 26:51-73).

Like Cry toxins, activated Vip3A toxins are pore-forming proteins capable of making stable ion channels in the membrane (Lee et al. (2003) *Appl. Environ. Microbiol.* 69:4648-4657). Vip3 proteins are active against several major lepidopteran pests (Rang et al. (2005) *Appl. Faviron. Microbiol.* 71(10):6276-6281; Bhalla et al. (2005) *FFMS Microbiol. Lett.* 243:467-472; Estruch et al. (1998) WO 9844137; Estruch el al. (1996) *Proc Natl Acad Sci USA* 93:5389-5394; Selvapandiyan et al. (2001) *Appl. Environ Microbiol.* 67:5855-5858; Yu el al. (1997) *Appl. Environ Microbiol.* 63:532-536). Vip3A is active against *Agrotis ipsilon, Spodoptera frugiperda, Spodoptera exigua, Heliothis virescens*, and *Helicoverpa zea* (Warren et al. (1996) WO 96/10083; Estruch et al. (1996) *Proc Natl Acad Sci USA* 93:5389-5394). Like Cry toxins, Vip3A proteins must be activated by proteases prior to recognition at the surface of the midgut epithelium of specific membrane proteins different from those recognized by Cry toxins.

The MTX family of toxin proteins is characterized by the presence of a conserved domain, ETX_MTX2 (pfam 03318). Members of this family share sequence homology with the mosquitocidal toxins Mtx2 and Mtx3 from *Bacillus sphaericus*, as well as with the epsilon toxin ETX from *Clostridium perfringens* (Cole et al. (2004) *Nat. Struct. Mol. Biol.* 11: 797-8; Thanabalu et al. (1996) *Gene* 170:85-89). The MTX-like proteins are structurally distinct from the three-domain Cry toxins, as they have an elongated and predominately β-sheet-based structure. However, similar to the three-domain toxins, the MTX-like proteins are thought to form pores in the membranes of target cells (Adang et al. (2014) supra). Unlike the three-domain Cry proteins, the MTX-like proteins are much smaller in length, ranging from 267 amino acids (Cry23) to 340 amino acids (Cry15A.

To date, only 15 proteins belonging to the family of MTX-like toxins have been assigned Cry names, making this a relatively small class compared to the three-domain Cry family (Crickmore et al. (2014) supra; Adang et al. (2014) supra). The members of the MTX-like toxin family include Cry15, Cry23, Cry33, Cry38, Cry45, Cry46, Cry51, Cry60A, Cry60B, and Cry64. This family exhibits a range of insecticidal activity, including activity against insect pests of the Lepidopteran and Coleopteran orders. Some members of this family may form binary partnerships with other proteins, which may or may not be required for insecticidal activity.

Cry15 is a 34 kDA protein that was identified in *Bacillus thuringiensis* serovar thompsoni HD542; it occurs naturally in a crystal together with an unrelated protein of approximately 40 kDa. The gene encoding Cry15 and its partner protein are arranged together in an operon. Cry15 alone has been shown to have activity against lepidopteran insect pests including *Manduca sexta, Cydia pomonella*, and *Pieris rapae*, with the presence of the 40 kDA protein having been shown to increase activity of Cry15 only against *C. pomonella* (Brown K. and Whiteley H. (1992) *J. Bacteriol.* 174:549-557; Naimov et al. (2008) *Appl. Environ. Microbiol.* 74:7145-7151). Further studies are needed to elucidate the function of the partner protein of Cry15. Similarly, Cry23 is a 29 kDA protein that has been shown to have activity against the coleopteran pests *Tribolium castaneum* and *Popillia japonica* together with its partner protein Cry37 (Donovan et al. (2000) U.S. Pat. No. 6,063,756).

New members of the MTX-like family are continuing to be identified. An ETX_MTX toxin gene was recently identified in the genome of *Bacillus thuringiensis* serovar tolworthi strain Na205-3. This strain was found to be toxic against the lepidpoteran pest *Helicoverpa armigera*, and it also contained homologs of Cry1, Cry11, Vip1, Vip2, and Vip3 (Palma et al. (2014) *Genome Announc.* 2(2). e00187-14. Published online Mar. 13, 2014 at doi: 10.1128/genomeA.00187-14; PMCID: PMC3953196). Because the MTX-like proteins have a unique domain structure relative to the three-domain Cry proteins, they are believed to possess a unique mode of action, thereby making them a valuable tool in insect control and the fight against insect resistance.

Bacterial cells produce large numbers of toxins with diverse specificity against host and non-host organisms. Large families of binary toxins have been identified in numerous bacterial families, including toxins that have activity against insect pests. (Poopathi and Abidha (2010) *J. Physiol. Path.* 1(3): 22-38.) *Lysinibacillus sphaericus* (Ls), formerly *Bacillus sphaericus* (Ahmed et al. (2007) *Int. J. Syst. Evol. Microbiol.* 57:1117-1125), is well-known as an insect biocontrol strain. Ls produces several insecticidal proteins, including the highly potent binary complex BinA/BinB. This binary complex forms a parasporal crystal in Ls cells and has strong and specific activity against dipteran insects, specifically mosquitos. In some areas, insect resistance to existing Ls mosquitocidal strains has been reported. The discovery of new binary toxins with different target specificity or the ability to overcome insect resistance is of significant interest.

The Ls binary insecticidal protein complex contains two major polypeptides, a 42 kDa polypeptide and a 51 kDa polypeptide, designated BinA and BinB, respectively (Ahmed et al. (2007) supra). The two polypeptides act synergistically to confer toxicity to their targets. Mode of action involves binding of the proteins to receptors in the larval midgut. In some cases, the proteins are modified by protease digestion in the larval gut to produce activated forms. The BinB component is thought to be involved in binding, while the BinA component confers toxicity (Nielsen-LeRoux et al. (2001) *Appl. Environ. Microbiol.* 67(11):5049-5054). When cloned and expressed separately, the BinA component is toxic to mosquito larvae, while the BinB component is not. However, co-administration of the proteins markedly increases toxicity (Nielsen-LeRoux et al. (2001) supra).

A small number of Bin protein homologs have been described from bacterial sources. Priest et al. (1997) *Appl. Environ. Microbiol.* 63(4):1195-1198 describe a hybridization effort to identify new Ls strains, although most of the genes they identified encoded proteins identical to the known BinA/BinB proteins. The BinA protein contains a defined conserved domain known as the Toxin 10 superfamily domain. This toxin domain was originally defined by its presence in BinA and BinB. The two proteins both have the domain, although the sequence similarity between BinA and BinB is limited in this region (<40%). The Cry49Aa protein, which also has insecticidal activity, also has this domain (described below).

The Cry48Aa/Cry49Aa binary toxin of Ls has the ability to kill *Culex quinquefasciatus* mosquito larvae. These proteins are in a protein structural class that has some similarity to the Cry protein complex of *Bacillus thuringiensis* (Bt), a well-known insecticidal protein family. The Cry34/Cry35 binary toxin of Bt is also known to kill insects, including Western corn rootworm, a significant pest of corn. Cry34, of which several variants have been identified, is a small (14 kDa) polypeptide, while Cry35 (also encoded by several variants) is a 44 kDa polypeptide. These proteins have some sequence homology with the BinA/BinB protein group and are thought to be evolutionarily related (Ellis et al. (2002) *Appl. Environ. Microbiol.* 68(3):1137-1145).

Phosphoinositide phospholipase C proteins (PI-PLC; also phosphotidylinositol phospholipase C) are members of the broader group of phospholipase C proteins. Many of these proteins play important roles in signal transduction as part of normal cell physiology. Several important bacterial toxins also contain domains with similarity to these proteins (Titball, R. W. (1993) *Microbiological Reviews.* 57(2):347-366). Importantly, these proteins are implicated in signal amplification during intoxication of insect cells by Bt Cry proteins (Valaitis, A. P. (2008) *Insect Biochemistry and Molecular Biology.* 38: 611-618).

The PI-PLC toxin class occurs in *Bacillus* isolates, commonly seen in co-occurrence with homologs to other described toxin classes, such as Binary Toxins. This class of sequences has homology to phosphatidylinositol phosphodiesterases (also referred to as phosphatidylinositol-specific phospholipase C-PI-PLC). The crystal structure and its active site were solved for *B. cereus* PI-PLC by Heinz et al. (Heinz, et. al., (1995) *The EMBO Journal.* 14(16): 3855-3863). The roles of the *B. cereus* PI-PLC active site amino acid residues in catalysis and substrate binding were investigated by Gässler et al. using site-directed mutagenesis, kinetics, and crystal structure analysis (Gässler, et. al., (1997) *Biochemistry.* 36(42):12802-13).

These PI-PLC toxin proteins contain a PLC-like phosphodiesterase, TIM beta/alpha-barrel domain (IPR017946) and/or a Phospholipase C, phosphatidylinositol-specific, X domain (IPR000909) (also referred to as the P1-PLC X-box domain). We have also seen proteins with these domains in combination with other typical *Bacillus* protein toxin domains. This list includes most commonly a lectin domain (IPR000772), a sugar-binding domain that can be present in one or more copies and is thought to bind cell membranes, as well as the Insecticidal crystal toxin (IPR008872) (also referred to as Toxin10 or P42), which is the defining domain of the Binary Toxin. An example of this domain structure is in sequence APG00732.

Previously, toxins of this PI-PLC class were defined in U.S. Pat. No. 8,318,900 B2 SEQ ID NOs 30 (DNA) and 79 (amino acid), in U.S. Patent Publication No. 20110263488A1 SEQ ID NOs 8 (DNA) and 9 (amino acid), and in U.S. Pat. No. 8,461,421B2 SEQ ID NOs 3 (DNA) and 63 (amino acid).

Provided herein are pesticidal proteins from these classes of toxins. The pesticidal proteins are classified by their structure, homology to known toxins and/or their pesticidal specificity.

ii. Variants and Fragments of Pesticidal Proteins and Polynucleotides Encoding the Same Pesticidal proteins or polypeptides of the invention include those set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, and/or 224 and fragments and variants thereof. By "pesticidal toxin" or "pesticidal protein" or "pesticidal polypeptide" is intended a toxin or protein or polypeptide that has activity against one or more pests, including, insects, fungi, nematodes, and the like such that the pest is killed or controlled.

An "isolated" or "purified" polypeptide or protein, or biologically active portion thereof, is substantially or essentially free from components that normally accompany or interact with the polypeptide or protein as found in its naturally occurring environment. Thus, an isolated or purified polypeptide or protein is substantially free of other cellular material, or culture medium when produced by recombinant techniques, or substantially free of chemical precursors or other chemicals when chemically synthesized. A protein that is substantially free of cellular material includes preparations of protein having less than about 30%, 20%, 10%, 5%, or 1% (by dry weight) of contaminating protein. When the protein of the invention or biologically active portion thereof is recombinantly produced, optimally culture medium represents less than about 30%, 20%, 10%, 5%, or 1% (by dry weight) of chemical precursors or non-protein-of-interest chemicals.

The term "fragment" refers to a portion of a polypeptide sequence of the invention. "Fragments" or "biologically active portions" include polypeptides comprising a sufficient number of contiguous amino acid residues to retain the biological activity, i.e., have pesticidal activity. Fragments of the pesticidal proteins include those that are shorter than the full-length sequences, either due to the use of an alternate downstream start site, or due to processing that produces a shorter protein having pesticidal activity. Processing may occur in the organism the protein is expressed in, or in the pest after ingestion of the protein. Examples of fragments of the proteins can be found in Table 1. A biologically active portion of a pesticidal protein can be a polypeptide that is, for example, 10, 25, 50, 100, 150, 200, 250 or more amino acids in length of any one of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, and/or 224. Such biologically active portions can be prepared by recombinant techniques and evaluated for pesticidal activity. As used here, a fragment comprises at least 8 contiguous amino acids of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, and/or 224.

Bacterial genes, including those encoding the pesticidal proteins disclosed herein, quite often possess multiple methionine initiation codons in proximity to the start of the open reading frame. Often, translation initiation at one or more of these start codons will lead to generation of a functional protein. These start codons can include ATG codons. However, bacteria such as *Bacillus* sp. also recognize the codon GTG as a start codon, and proteins that initiate translation at GTG codons contain a methionine at the first amino acid. On rare occasions, translation in bacterial systems can initiate at a TTG codon, though in this event the TTG encodes a methionine. Furthermore, it is not often determined a priori which of these codons are used naturally in the bacterium. Thus, it is understood that use of one of the alternate methionine codons may also lead to generation of pesticidal proteins. These pesticidal proteins are encompassed in the present invention and may be used in the methods disclosed herein. It will be understood that, when expressed in plants, it will be necessary to alter the alternate start codon to ATG for proper translation.

In various embodiments, the pesticidal proteins provided herein include amino acid sequences deduced from the full-length nucleotide sequences and amino acid sequences that are shorter than the full-length sequences due to the use of an alternate downstream start site. Thus, the nucleotide sequence of the invention and/or vectors, host cells, and plants comprising the nucleotide sequence of the invention (and methods of making and using the nucleotide sequence of the invention) may comprise a nucleotide sequence encoding an alternate start site.

It is recognized that modifications may be made to the pesticidal polypeptides provided herein creating variant proteins. Changes designed by man may be introduced through the application of site-directed mutagenesis techniques. Alternatively, native, as yet-unknown or as yet unidentified polynucleotides and/or polypeptides structurally and/or functionally-related to the sequences disclosed herein may also be identified that fall within the scope of the present invention. Conservative amino acid substitutions may be made in nonconserved regions that do not alter the function of the pesticidal proteins. Alternatively, modifications may be made that improve the activity of the toxin. Modification of Cry toxins by domain III swapping has resulted in some cases in hybrid toxins with improved toxicities against certain insect species. Thus, domain III swapping could be an effective strategy to improve toxicity of Cry toxins or to create novel hybrid toxins with toxicity against pests that show no susceptibility to the parental Cry toxins. Site-directed mutagenesis of domain II loop sequences may result in new toxins with increased insecticidal activity. Domain II loop regions are key binding regions of initial Cry toxins that are suitable targets for the mutagenesis and selection of Cry toxins with improved insecticidal properties. Domain I of the Cry toxin may be modified to introduce protease cleavage sites to improve activity against certain pests. Strategies for shuffling the three different domains among large numbers of cry genes and high through output bioassay screening methods may provide novel Cry toxins with improved or novel toxicities.

As indicated, fragments and variants of the polypeptides disclosed herein will retain pesticidal activity. Pesticidal activity comprises the ability of the composition to achieve an observable effect diminishing the occurrence or an activity of the target pest, including for example, bringing about death of at least one pest, or a noticeable reduction in pest growth, feeding, or normal physiological development. Such decreases in numbers, pest growth, feeding or normal development can comprise any statistically significant decrease, including, for example a decrease of about 5%, 10%, 15%, 20%, 25%, 30%, 35%, 40%, 45%, 50%, 55%, 60%, 65%, 70%, 75%, 85%, 90%, 95% or greater. It is recognized that the pesticidal activity may be different or improved relative to the activity of the native protein, or it may be unchanged, so long as pesticidal activity is retained. Methods for measuring pesticidal activity are well known in the art. See, for example, Czapla and Lang (1990) *J. Econ. Entomol.* 83:2480-2485; Andrews et al. (1988) *Biochem. J.* 252:199-206; Marrone et al. (1985) *J. of Economic Entomology* 78:290-293; and U.S. Pat. No. 5,743,477, all of which are herein incorporated by reference in their entirety.

Polypeptide variants of this disclosure include polypeptides having an amino acid sequence that is at least about 60%, about 65%, about 70%, about 75%, about 80%, about 85%, about 86%, about 87%, about 88%, about 89%, about 90%, about 91%, about 92%, about 93%, about 94%, about 95%, about 96%, about 97%, about 98% or about 99% identical to the amino acid sequence of any of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, and/or 224 and retain pesticidal activity. Note, Table 1 provides non-limiting examples of variant polypeptides (and polynucleotide encoding the same) for each of SEQ ID NOS: 1-224. A biologically active variant of a pesticidal polypeptide of the invention may differ by as few as about 1-15 amino acid residues, as few as about 1-10, such as about 6-10, as few as 5, as few as 4, as few as 3, as few as 2, or as few as 1 amino acid residue. In specific embodiments, the polypeptides can comprise an N'-terminal or a C'-terminal truncation, which can comprise at least a deletion of 10, 15, 20, 25, 30, 35, 40, 45, 50 amino acids or more from either the N' or C' terminal end of the polypeptide.

Table 2 provides protein domains found in SEQ ID NOs: 1-224 based on PFAM data. Both the domain description and the positions within a given SEQ ID NO are provided in Table 2. In specific embodiments, the active variant comprising any one of SEQ ID NOs: 1-224 can comprise at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to any one of SEQ ID NOs: 1-224 and further comprises at least one of the conserved domain set forth in Table 2. For example, in one embodiment, the active variant will comprise at least 70%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to SEQ ID NO:3, and further comprises the native amino acids at positions 207-400.

TABLE 2

Summary of PFAM domains in each of SEQ ID NOs: 1-224

| APG ID | Seq ID | Modification Type | PFAM Domain | Domain Description | Domain Position Start | Domain Position Stop |
|---|---|---|---|---|---|---|
| APG00078 | Seq ID 1 | | PF00388 | PI-PLC-X | 63 | 215 |
| | | | PF14200 | RicinB lectin 2 | 512 | 613 |
| APG00078 modified | Seq ID 2 | Alternate start | PF00388 | PI-PLC-X | 43 | 195 |
| | | | PF14200 | RicinB lectin 2 | 492 | 593 |
| APG00306 | Seq ID 3 | | PF05431 | Toxin 10 | 207 | 400 |
| APG00310 | Seq ID 4 | | PF03945 | Endotoxin N | 64 | 303 |
| | | | PF00555 | Endotoxin M | 308 | 523 |
| | | | PF03944 | Endotoxin C | 533 | 674 |
| APG00310 modified | Seq ID 5 | 3' Truncation | PF03945 | Endotoxin N | 64 | 303 |
| | | | PF00555 | Endotoxin M | 308 | 523 |
| | | | PF03944 | Endotoxin C | 533 | 673 |
| APG00311 | Seq ID 6 | | PF03318 | ETX MTX2 | 136 | 378 |
| APG00312 | Seq ID 7 | | PF05791 | Bacillus HBL | 58 | 201 |
| APG00313 | Seq ID 8 | | PF03945 | Endotoxin N | 10 | 244 |
| | | | PF01473 | CW binding 1 | 356 | 371 |
| | | | PF01473 | CW binding 1 | 385 | 399 |
| | | | PF01473 | CW binding 1 | 456 | 475 |
| APG00316 | Seq ID 9 | | PF03945 | Endotoxin N | 76 | 303 |
| | | | PF03944 | Endotoxin C | 494 | 640 |
| APG00316 modified | Seq ID 10 | 3' Truncation | PF03945 | Endotoxin N | 76 | 303 |
| | | | PF00555 | Endotoxin M | 308 | 484 |
| | | | PF03944 | Endotoxin C | 494 | 639 |
| APG00316 CryBP1 | Seq ID 11 | | PF07029 | CryBP1 | 20 | 178 |
| APG00325 | Seq ID 12 | | PF03318 | ETX MTX2 | 103 | 330 |
| APG00327 | Seq ID 13 | | PF01338 | Bac thur toxin | 54 | 258 |
| APG00328 | Seq ID 14 | | no PFAM domains | | | |
| APG00331 | Seq ID 15 | | PF14200 | Ricin B lectin 2 | 26 | 136 |
| | | | PF05431 | Toxin 10 | 195 | 388 |
| APG00333 | Seq ID 16 | | PF03318 | ETX MTX2 | 84 | 315 |
| APG00334 | Seq ID 17 | | PF03945 | Endotoxin N | 130 | 308 |
| | | | PF14200 | RicinB lectin 2 | 444 | 544 |
| APG00335 | Seq ID 18 | | PF05431 | Toxin 10 | 235 | 431 |
| APG00336 | Seq ID 19 | | PF05431 | Toxin 10 | 223 | 418 |
| APG00337 | Seq ID 20 | | PF03318 | ETX MTX2 | 29 | 280 |
| APG00338 | Seq ID 21 | | PF00388 | PI-PLC-X | 55 | 200 |
| | | | PF14200 | RicinB lectin 2 | 483 | 583 |
| APG00344 | Seq ID 22 | | PF03318 | ETX MTX2 | 92 | 310 |
| APG00345 | Seq ID 23 | | PF03318 | ETX MTX2 | 18 | 245 |
| APG00346 | Seq ID 24 | | PF03318 | ETX MTX2 | 31 | 272 |
| APG00347 | Seq ID 25 | | P103318 | ETX MTX2 | 38 | 329 |
| APG00348 | Seq ID 26 | | PF03945 | Endotoxin N | 129 | 345 |
| | | | PF14200 | RicinB lectin 2 | 492 | 592 |
| APG00350 | Seq ID 27 | | PF03318 | ETX MTX2 | 55 | 284 |
| APG00351 | Seq ID 28 | | PF03318 | ETX MTX2 | 88 | 315 |
| APG00352 | Seq ID 29 | | PF03318 | ETX MTX2 | 132 | 359 |
| APG00357 | Seq ID 30 | | PF01338 | Bac thur toxin | 33 | 254 |
| APG00358 | Seq ID 31 | | PF12495 | Vip3A N | 16 | 188 |
| | | | PF02018 | CBM 4 9 | 810 | 898 |
| APG00361 | Seq ID 32 | | no PFAM domains | | | |
| APG00362 | Seq ID 33 | | PF03318 | ETX MTX2 | 86 | 311 |
| APG00363 | Seq ID 34 | | PF03945 | Endotoxin N | 109 | 339 |
| | | | PF01473 | CW binding 1 | 408 | 422 |
| | | | PF01473 | CW binding 1 | 457 | 471 |
| | | | PF01473 | CW binding 1 | 574 | 590 |

TABLE 2-continued

Summary of PFAM domains in each of SEQ ID NOs: 1-224

| APG ID | Seq ID | Modification Type | PFAM Domain | Domain Description | Domain Position Start | Domain Position Stop |
|---|---|---|---|---|---|---|
| APG00364 | Seq ID 35 | | PF03318 | ETX MTX2 | 112 | 251 |
| APG00365 | Seq ID 36 | | PF03318 | ETX MTX2 | 55 | 304 |
| APG00366 | Seq ID 37 | | PF03318 | ETX MTX2 | 121 | 353 |
| APG00370 | Seq ID 38 | | PF03945 | Endotoxin N | 72 | 172 |
| | | | PF03945 | Endotoxin N | 220 | 359 |
| | | | PF03944 | Endotoxin C | 583 | 729 |
| APG00370 modified | Seq ID 39 | 3' Truncation | PF03945 | Endotoxin N | 72 | 173 |
| | | | PF03945 | Endotoxin N | 220 | 359 |
| | | | PF03944 | Endotoxin C | 570 | 728 |
| APG00374 | Seq ID 40 | | PF03945 | Endotoxin N | 84 | 319 |
| | | | PF00555 | Endotoxin M | 333 | 523 |
| | | | PF03944 | Endotoxin C | 533 | 677 |
| APG00374 modified | Seq ID 41 | 3' Truncation | PF03945 | Endotoxin N | 84 | 319 |
| | | | PF00555 | Endotoxin M | 333 | 523 |
| | | | PF03944 | Endotoxin C | 533 | 676 |
| APG00378 | Seq ID 42 | | PF05791 | Bacillus HBL | 53 | 235 |
| APG00380 | Seq ID 43 | | PF00652 | Ricin B lectin | 25 | 158 |
| | | | PF05431 | Toxin 10 | 169 | 364 |
| APG00384 | Seq ID 44 | | PF03318 | ETX MTX2 | 74 | 379 |
| APG00387 | Seq ID 45 | | PF03318 | ETX MTX2 | 79 | 799 |
| APG00389 | Seq ID 46 | | PF03945 | Endotoxin N | 58 | 295 |
| | | | PF00555 | Endotoxin M | 404 | 485 |
| | | | PF03944 | Endotoxin C | 495 | 631 |
| APG00389 modified | Seq ID 47 | 3' Truncation | PF03945 | Endotoxin N | 58 | 295 |
| | | | PF00555 | Endotoxin M | 404 | 485 |
| | | | PF03944 | Endotoxin C | 495 | 630 |
| APG00394 | Seq ID 48 | | PF01338 | Bac thur toxin | 2 | 217 |
| APG00405 | Seq ID 49 | | PF05791 | Bacillus HBL | 40 | 224 |
| APG00406 | Seq ID 50 | | PF03318 | ETX MTX2 | 102 | 338 |
| APG00423 | Seq ID 51 | | PF03318 | ETX MTX2 | 57 | 277 |
| APG00424 | Seq ID 52 | | PF03945 | Endotoxin N | 100 | 303 |
| APG00429 | Seq ID 53 | | PF03318 | ETX MTX2 | 93 | 334 |
| APG00430 | Seq ID 54 | | PF03945 | Endotoxin N | 63 | 313 |
| | | | PF00555 | Endotoxin M | 320 | 494 |
| | | | PF03944 | Endotoxin C | 520 | 656 |
| APG00430 modified | Seq ID 55 | 3' Truncation | PF03945 | Endotoxin N | 63 | 313 |
| | | | PF00555 | Endotoxin M | 320 | 494 |
| | | | PF03944 | Endotoxin C | 520 | 655 |
| APG00431 | Seq ID 56 | | PF01338 | Bac thur toxin | 23 | 247 |
| APG00433 | Seq ID 57 | | PF03318 | ETX MTX2 | 28 | 283 |
| APG00434 | Seq ID 58 | | PF03318 | ETX MTX2 | 30 | 274 |
| APG00435 | Seq ID 59 | | PF03945 | Endotoxin N | 114 | 329 |
| | | | PF01473 | CW binding 1 | 379 | 395 |
| | | | PF01473 | CW binding 1 | 457 | 474 |
| | | | PF01473 | CW binding 1 | 490 | 508 |
| | | | PF01473 | CW binding 1 | 523 | 538 |
| APG00436 | Seq ID 60 | | PF03945 | Endotoxin N | 54 | 288 |
| | | | PF00555 | Endotoxin M | 293 | 501 |
| | | | PF03944 | Endotoxin C | 511 | 577 |
| APG00436 modified | Seq ID 61 | 3' Truncation | PF03945 | Endotoxin N | 54 | 288 |
| | | | PF00555 | Endotoxin M | 293 | 501 |
| | | | PF03944 | Endotoxin C | 511 | 576 |
| APG00437 | Seq ID 62 | | PF01338 | Bac thur toxin | 30 | 250 |
| APG00438 | Seq ID 63 | | PF03318 | ETX MTX2 | 135 | 369 |
| APG00439 | Seq ID 64 | | PF01338 | Bac thur toxin | 266 | 461 |
| APG00440 | Seq ID 65 | | PF05431 | Toxin 10 | 163 | 360 |
| APG00442 | Seq ID 66 | | PF03945 | Endotoxin N | 100 | 355 |
| | | | PF03944 | Endotoxin C | 550 | 676 |
| APG00445 | Seq ID 67 | | PF03318 | ETX MTX2 | 48 | 316 |
| APG00446 | Seq ID 68 | | PF03945 | Endotoxin N | 103 | 299 |
| | | | PF14200 | RicinB lectin 2 | 413 | 516 |
| APG00447 | Seq ID 69 | | PF00388 | PI-PLC-X | 53 | 200 |
| APG00448 | Seq ID 70 | | PF03318 | ETX MTX2 | 110 | 247 |
| APG00449 | Seq ID 71 | | PF00652 | Ricin B lectin | 70 | 173 |
| | | | PF05431 | Toxin 10 | 167 | 362 |
| | | | PF03495 | Binary toxB | 234 | 351 |
| APG00450 | Seq ID 72 | | PF03318 | ETX MTX2 | 19 | 275 |
| APG00452 | Seq ID 73 | | PF03945 | Endotoxin N | 77 | 322 |
| | | | PF14200 | RicinB lectin 2 | 874 | 981 |
| APG00458 | Seq ID 74 | | PF03318 | ETX MTX2 | 79 | 335 |
| APG00460 | Seq ID 75 | | PF03945 | Endotoxin N | 91 | 291 |

TABLE 2-continued

Summary of PFAM domains in each of SEQ ID NOs: 1-224

| APG ID | Seq ID | Modification Type | PFAM Domain | Domain Description | Domain Position Start | Domain Position Stop |
|---|---|---|---|---|---|---|
| APG00463 | Seq ID 76 | | PF03945 | Endotoxin N | 57 | 312 |
| | | | PF00555 | Endotoxin M | 317 | 537 |
| | | | PF03944 | Endotoxin C | 547 | 686 |
| APG00463 modified | Seq ID 77 | 3' Truncation | PF03945 | Endotoxin N | 57 | 312 |
| | | | PF00555 | Endotoxin M | 317 | 537 |
| | | | PF03944 | Endotoxin C | 547 | 685 |
| APG00464 | Seq ID 78 | | PF01338 | Bac thur toxin | 10 | 205 |
| APG00465 | Seq ID 79 | | PF03945 | Endotoxin N | 2 | 177 |
| | | | PF01473 | CW binding 1 | 190 | 203 |
| | | | PF01473 | CW binding 1 | 240 | 256 |
| | | | PF01473 | CW binding 1 | 268 | 283 |
| | | | PF01473 | CW binding 1 | 322 | 336 |
| APG00466 | Seq ID 80 | | PF03318 | ETX MTX2 | 73 | 302 |
| APG00468 | Seq ID 81 | | PF01338 | Bac thur toxin | 17 | 240 |
| APG00469 | Seq ID 82 | | PF03945 | Endotoxin N | 64 | 302 |
| | | | PF00555 | Endotoxin M | 307 | 528 |
| | | | PF03944 | Endotoxin C | 538 | 687 |
| APG00469 modified | Seq ID 83 | 3' Truncation | PF03945 | Endotoxin N | 64 | 302 |
| | | | PF00555 | Endotoxin M | 307 | 528 |
| | | | PF03944 | Endotoxin C | 538 | 686 |
| APG00470 | Seq ID 84 | | PF03318 | ETX MTX2 | 149 | 383 |
| | | | PF01473 | CW binding 1 | 435 | 453 |
| | | | PF01473 | CW binding 1 | 522 | 539 |
| APG00471 | Seq ID 85 | | PF03945 | Endotoxin N | 111 | 286 |
| | | | PF14200 | RicinB lectin 2 | 516 | 618 |
| APG00472 | Seq ID 86 | | PF05431 | Toxin 10 | 154 | 347 |
| APG00473 | Seq ID 87 | | PF03945 | Endotoxin N | 107 | 341 |
| APG00473 modified | Seq ID 88 | 3' Truncation | PF03945 | Endotoxin N | 107 | 341 |
| APG00474 | Seq ID 89 | | PF05431 | Toxin 10 | 169 | 363 |
| APG00475 | Seq ID 90 | | PF03318 | ETX MTX2 | 133 | 354 |
| APG00476 | Seq ID 91 | | PF03318 | ETX MTX2 | 112 | 348 |
| APG00478 | Seq ID 92 | | PF03945 | Endotoxin N | 105 | 346 |
| APG00478 CryBP1 | Seq ID 93 | | PF07029 | CryBP1 | 31 | 187 |
| APG00482 | Seq ID 94 | | PF00652 | Ricin B lectin | 63 | 184 |
| | | | PF05431 | Toxin 10 | 194 | 394 |
| APG00487 | Seq ID 95 | | PF01338 | Bac thur toxin | 21 | 242 |
| APG00501 | Seq ID 96 | | PF03318 | ETX MTX2 | 1 | 212 |
| APG00502 | Seq ID 97 | | PF03945 | Endotoxin N | 110 | 308 |
| APG00503 | Seq ID 98 | | no PFAM domains | | | |
| APG00504 | Seq ID 99 | | PF03945 | Endotoxin N | 61 | 292 |
| | | | PF00555 | Endotoxin M | 297 | 507 |
| | | | PF03944 | Endotoxin C | 517 | 663 |
| APG00504 modified | Seq ID 100 | 3' Truncation | PF03945 | Endotoxin N | 61 | 292 |
| | | | PF00555 | Endotoxin M | 297 | 507 |
| | | | PF03944 | Endotoxin C | 517 | 662 |
| APG00505 | Seq ID 101 | | PF03318 | ETX MTX2 | 37 | 263 |
| APG00506 | Seq ID 102 | | PF03318 | ETX MTX2 | 24 | 284 |
| APG00507 | Seq ID 103 | | PF03318 | ETX MTX2 | 106 | 329 |
| APG00518 | Seq ID 104 | | PF03945 | Endotoxin N | 2 | 85 |
| | | | PF00555 | Endotoxin M | 93 | 268 |
| | | | PF03944 | Endotoxin C | 276 | 416 |
| APG00518 modified | Seq ID 105 | 3' Truncation | PF03945 | Endotoxin N | 2 | 85 |
| | | | PF00555 | Endotoxin M | 93 | 268 |
| | | | PF03944 | Endotoxin C | 276 | 415 |
| APG00518 Split-Cry C-term | Seq ID 106 | | no PFAM domains | | | |
| APG00548 | Seq ID 107 | | PF01338 | Bac thur toxin | 121 | 316 |
| APG00549 | Seq ID 108 | | no PFAM domains | | | |
| APG00551 | Seq ID 109 | | PF05431 | Toxin 10 | 112 | 305 |
| APG00552 | Seq ID 110 | | PF03318 | ETX MTX2 | 71 | 311 |
| APC00561 | Seq ID 111 | | PF03318 | ETX MTX2 | 57 | 326 |
| APG00582 | Seq ID 112 | | PF03945 | Endotoxin N | 94 | 323 |
| | | | PF00555 | Endotoxin M | 328 | 535 |
| | | | PF03944 | Endotoxin C | 545 | 682 |
| APG00587 modified | Seq ID 113 | 3' Truncation | PF03945 | Endotoxin N | 94 | 323 |
| | | | PF00555 | Endotoxin M | 328 | 535 |
| | | | PF03944 | Endotoxin C | 545 | 682 |
| APG00583 | Seq ID 114 | | PF03318 | ETX MTX2 | 34 | 284 |
| APG00584 | Seq ID 115 | | no PFAM domains | | | |
| APG00585 | Seq ID 116 | | PF03318 | ETX MTX2 | 86 | 321 |

TABLE 2-continued

| Summary of PFAM domains in each of SEQ ID NOs: 1-224 | | | | | | |
|---|---|---|---|---|---|---|
| | | Modification | PFAM | Domain | Domain Position | |
| APG ID | Seq ID | Type | Domain | Description | Start | Stop |
| APC00599 | Seq ID 117 | | PF03945 | Endotoxin N | 54 | 288 |
| | | | P100555 | Endotoxin M | 293 | 501 |
| | | | PF03944 | Endotoxin C | 511 | 576 |
| APG00602 | Seq ID 118 | | PF14200 | RicinB lectin 2 | 3 | 102 |
| | | | PF05431 | Toxin 10 | 156 | 353 |
| APG00615 | Seq ID 119 | | PF03945 | Endotoxin N | 119 | 303 |
| | | | PF01473 | CW binding 1 | 421 | 440 |
| | | | PF01473 | CW binding 1 | 442 | 456 |
| APG00616 | Seq ID 120 | | PF03945 | Endotoxin N | 113 | 336 |
| APG00617 | Seq ID 121 | | PF03945 | Endotoxin N | 132 | 381 |
| APG00617 modified | Seq ID 122 | 3' Truncation | PF03945 | Endotoxin N | 132 | 381 |
| | | | PF03944 | Endotoxin C | 623 | 788 |
| APG00618 | Seq ID 123 | | PF03945 | Endotoxin N | 67 | 288 |
| APG00626 | Seq ID 124 | | PF03945 | Endotoxin N | 109 | 301 |
| | | | PF01473 | CW binding 1 | 409 | 426 |
| | | | PF01473 | CW binding 1 | 441 | 455 |
| APG00627 | Seq ID 125 | | no PFAM domains | | | |
| APG00629 | Seq ID 126 | | PF05431 | Toxin 10 | 212 | 406 |
| APG00631 | Seq ID 127 | | PF05791 | Bacillus HBL | 56 | 201 |
| APG00632 | Seq ID 128 | | PF03945 | Endotoxin N | 68 | 285 |
| | | | P109131 | Endotoxin mid | 286 | 493 |
| | | | PF03944 | Endotoxin C | 515 | 649 |
| APG00632 modified | Seq ID 129 | 3' Truncation | PF03945 | Endotoxin N | 68 | 285 |
| | | | PF09131 | Endotoxin mid | 286 | 493 |
| | | | PF03944 | Endotoxin C | 515 | 648 |
| APG00699 | Seq ID 130 | | PF05791 | Bacillus HBL | 46 | 227 |
| APG00734 | Seq ID 131 | | PF05431 | Toxin 10 | 282 | 478 |
| APG00750 | Seq ID 132 | | PF05431 | Toxin 10 | 223 | 418 |
| APG00875 | Seq ID 133 | | PF12495 | Vip3A n | 16 | 188 |
| | | | PF02018 | CBM 4 9 | 818 | 927 |
| APG00880 | Seq ID 134 | | PF14200 | RicinB lectin 2 | 1 | 96 |
| | | | PF05431 | Toxin 10 | 150 | 344 |
| APG00900 | Seq ID 135 | | PF05791 | Bacillus HBL | 40 | 226 |
| APG00951 | Seq ID 136 | | PF05791 | Bacillus HBL | 48 | 205 |
| APG00975 | Seq ID 137 | | PF12495 | Vip3 A N | 32 | 208 |
| APG00306 modified | Seq ID 138 | Signal peptide removed | PF05431 | Toxin 10 | 178 | 371 |
| APG00311 modified | Seq ID 139 | Signal peptide removed | PF03318 | ETX MTX2 | 105 | 347 |
| APG00316 modified | Seq ID 140 | Alternate start | P103945 | Endotoxin N | 63 | 290 |
| | | | PF03944 | Endotoxin C | 481 | 627 |
| APG00316 modified | Seq ID 141 | Alternate start and 3' Truncation | PF03945 | Endotoxin N | 63 | 290 |
| | | | PF00555 | Endotoxin M | 295 | 471 |
| | | | PF03944 | Endotoxin C | 481 | 626 |
| APG00325 modified | Seq ID 142 | Signal peptide removed | PF03318 | ETX MTX2 | 60 | 286 |
| APG00327 modified | Seq ID 143 | Alternate start | PF01338 | Bac thur toxin | 1 | 194 |
| APG00331 modified | Seq ID 144 | Signal peptide removed | PF14200 | RicinB lectin 2 | 1 | 109 |
| | | | PF05431 | Toxin 10 | 168 | 361 |
| APG00333 modified | Seq ID 145 | Signal peptide removed | PF03318 | ETX MTX2 | 56 | 287 |
| APG00334 modified | Seq ID 146 | Signal peptide removed | PF03945 | Endotoxin N | 78 | 256 |
| | | | PF14200 | RicinB lectin 2 | 392 | 492 |
| APG00335 modified | Seq ID 147 | Alternate start | PF05431 | Toxin 10 | 193 | 389 |
| APG0033 modified | Seq ID 148 | Alternate start | PF05431 | Toxin 10 | 190 | 385 |
| APG00337 modified | Seq ID 149 | Signal peptide removed | PF03318 | ETX MTX2 | 6 | 250 |
| APG00344 modified | Seq ID 150 | Signal peptide removed | PF03318 | ETX MTX2 | 58 | 276 |
| APG00347 modified | Seq ID 151 | Signal peptide removed | PF03318 | ETX MTX2 | 7 | 297 |
| APG00348 modified | Seq ID 152 | Signal peptide removed | PF03945 | Endotoxin N | 91 | 306 |
| | | | PF14200 | RicinB lectin 2 | 452 | 554 |
| APG00350 modified | Seq ID 153 | Signal peptide removed | PF03318 | ETX MTX2 | 25 | 252 |
| APG00351 modified | Seq ID 154 | Signal peptide removed | PF03318 | ETX MTX2 | 36 | 266 |
| APG00352 modified | Seq ID 155 | Signal peptide removed | PF03318 | ETX MTX2 | 101 | 328 |

TABLE 2-continued

Summary of PFAM domains in each of SEQ ID NOs: 1-224

| APG ID | Seq ID | Modification Type | PFAM Domain | Domain Description | Domain Position Start | Domain Position Stop |
|---|---|---|---|---|---|---|
| APG00358 modified | Seq ID 156 | Alternate start | PF12495 | Vip3A N | 14 | 186 |
| | | | PF02018 | CBM 4 9 | 808 | 896 |
| APG00362 modified | Seq ID 157 | Signal peptide removed | PF03318 | ETX MTX2 | 53 | 278 |
| APG00363 modified | Seq ID 158 | Signal peptide removed | PF03945 | Endotoxin N | 71 | 301 |
| | | | PF01473 | CW binding 1 | 370 | 384 |
| | | | PF01473 | CW binding 1 | 419 | 433 |
| | | | PF01473 | CW binding 1 | 536 | 552 |
| APG00364 modified | Seq ID 159 | Signal peptide removed | PF03318 | ETX MTX2 | 80 | 221 |
| APG00365 modified | Seq ID 160 | Alternate start | PF03318 | ETX MTX2 | 26 | 273 |
| APG00366 modified | Seq ID 161 | Signal peptide removed | PF03318 | ETX MTX2 | 92 | 326 |
| APG00370 modified | Seq ID 162 | Alternate start | P103945 | Endotoxin N | 72 | 172 |
| | | | PF03945 | Endotoxin N | 220 | 359 |
| | | | PF03944 | Endotoxin C | 583 | 729 |
| APG00370 modified | Seq ID 163 | Alternate start and 3' Truncation | PF03945 | Endotoxin N | 72 | 173 |
| | | | PF03945 | Endotoxin N | 220 | 359 |
| | | | PF03944 | Endotoxin C | 570 | 728 |
| APG00374 | Seq ID 164 | Alternate start and 3' Truncation | PF03945 | Endotoxin N | 74 | 309 |
| | | | PF00555 | Endotoxin M | 323 | 513 |
| | | | PF03944 | Endotoxin C | 523 | 667 |
| APG00378 modified | Seq ID 165 | Signal peptide removed | PF05791 | Bacillus HBL | 24 | 206 |
| APG00384 modified | Seq ID 166 | Signal peptide removed | PF03318 | ETX MTX2 | 42 | 296 |
| APG00387 modified | Seq ID 167 | Signal peptide removed | PF03318 | ETX MTX2 | 45 | 265 |
| APG00389 | Seq ID 168 | Signal peptide removed | PF03945 | Endotoxin N | 1 | 204 |
| | | | PF00555 | Endotoxin M | 313 | 394 |
| | | | PF03944 | Endotoxin C | 404 | 540 |
| APG00394 modified | Seq ID 169 | Alternate start | PF01338 | Bac thur toxin | 2 | 215 |
| APG00405 modified | Seq ID 170 | Signal peptide removed | PF05791 | Bacillus HBL | 12 | 196 |
| APG00406 modified | Seq ID 171 | Signal peptide removed | PF03318 | ETX MTX2 | 73 | 309 |
| APG00423 modified | Seq ID 172 | Signal peptide removed | PF03318 | ETX MTX2 | 39 | 259 |
| APG00429 modified | Seq ID 173 | Signal peptide removed | PF03318 | ETX MTX2 | 60 | 301 |
| APG00433 modified | Seq ID 174 | Signal peptide removed | PF03318 | ETX MTX2 | 25 | 259 |
| APG00437 modified | Seq ID 175 | Alternate start | PF01338 | Bac thur toxin | 14 | 234 |
| APG00438 modified | Seq ID 176 | Signal peptide removed | PF03318 | ETX MTX2 | 101 | 335 |
| APG00439 modified | Seq ID 177 | Alternate start | PF01338 | Bac thur toxin | 1 | 192 |
| APG00442 modified | Seq ID 178 | Signal peptide removed | PF03945 | Endotoxin N | 70 | 325 |
| | | | PF03944 | Endotoxin C | 520 | 646 |
| APG00442 modified | Seq ID 179 | Signal peptide removed and 3' Truncation | PF03945 | Endotoxin N | 70 | 325 |
| | | | PF03944 | Endotoxin C | 520 | 645 |
| APG00445 modified | Seq ID 180 | Alternate start | PF03318 | ETX MTX2 | 19 | 287 |
| APG00446 modified | Seq ID 181 | Signal peptide removed | PF03945 | Endotoxin N | 62 | 258 |
| | | | PF14200 | RicinB lectin 2 | 372 | 475 |
| APG00448 modified | Seq ID 182 | Signal peptide removed | PF03318 | ETX MTX2 | 79 | 204 |
| APG00450 modified | Seq ID 183 | Alternate start | PF03318 | ETX MTX2 | 19 | 275 |
| APG00452 modified | Seq ID 184 | Alternate start | PF03945 | Endotoxin N | 27 | 272 |
| | | | PF14200 | RicinB lectin 2 | 824 | 931 |
| APG00460 modified | Seq ID 185 | Signal peptide removed | PF03945 | Endotoxin N | 4 | 171 |
| APG00465 modified | Seq ID 186 | Alternate start | PF03945 | Endotoxin N | 1 | 177 |
| | | | PF01473 | CW binding 1 | 190 | 203 |
| | | | PF01473 | CW binding 1 | 240 | 256 |
| | | | PF01473 | CW binding 1 | 268 | 283 |
| | | | PF01473 | CW binding 1 | 322 | 336 |
| APG00466 modified | Seq ID 187 | Signal peptide removed | PF03318 | ETX MTX2 | 41 | 270 |

TABLE 2-continued

Summary of PFAM domains in each of SEQ ID NOs: 1-224

| APG ID | Seq ID | Modification Type | PFAM Domain | Domain Description | Domain Position Start | Domain Position Stop |
|---|---|---|---|---|---|---|
| APG00470 modified | Seq ID 188 | Signal peptide removed | PF03318 | ETX MTX2 | 115 | 349 |
| | | | PF01473 | CW binding 1 | 401 | 419 |
| | | | PF01473 | CW binding 1 | 488 | 505 |
| APG00471 modified | Seq ID 189 | Signal peptide removed | PF03945 | Endotoxin N | 73 | 248 |
| | | | PF14200 | RicinB lectin 2 | 478 | 580 |
| APG00473 modified | Seq ID 190 | Alternate start | PF03945 | Endotoxin N | 90 | 324 |
| APG00473 modified | Seq ID 191 | Alternate start and 3' Truncation | PF03945 | Endotoxin N | 90 | 324 |
| APG00474 modified | Seq ID 192 | Alternate start | PF05431 | Toxin 10 | 166 | 360 |
| APG00475 modified | Seq ID 193 | Signal peptide removed | PF03318 | ETX MTX2 | 98 | 315 |
| APG00476 modified | Seq ID 194 | Signal peptide removed | PF03318 | ETX MTX2 | 67 | 303 |
| APG00482 modified | Seq ID 195 | Alternate start | PF00652 | Ricin B lectin | 38 | 159 |
| | | | PF05431 | Toxin 10 | 169 | 369 |
| APG00501 modified | Seq ID 196 | Alternate start | PF03318 | ETX MTX2 | 1 | 212 |
| APG00505 modified | Seq ID 197 | Signal peptide removed | PF03318 | ETX MTX2 | 6 | 232 |
| APG00506 modified | Seq ID 198 | Alternate start | PF03318 | ETX MTX2 | 12 | 272 |
| APG00507 modified | Seq ID 199 | Signal peptide removed | PF03318 | ETX MTX2 | 77 | 299 |
| APG00518 modified | Seq ID 200 | Alternate start | PF03945 | Endotoxin N | 5 | 85 |
| | | | PF00555 | Endotoxin M | 93 | 268 |
| | | | PF03944 | Endotoxin C | 276 | 416 |
| APG00518 modified | Seq ID 201 | Alternate start and 3' Truncation | PF03945 | Endotoxin N | 5 | 85 |
| | | | PF00555 | Endotoxin M | 93 | 268 |
| | | | PF03944 | Endotoxin C | 276 | 415 |
| APG00548 modified | Seq ID 202 | Alternate start | PF01338 | Bac thur toxin | 1 | 192 |
| APG00549 modified | Seq ID 203 | Alternate start | no PFAM domains | | | |
| APG00551 modified | Seq ID 204 | Alternate start | PF05431 | Toxin 10 | 112 | 305 |
| APG00552 modified | Seq ID 205 | Signal peptide removed | PF03318 | ETX MTX2 | 37 | 278 |
| APG00561 modified | Seq ID 206 | Signal peptide removed | PF03318 | ETX MTX2 | 34 | 303 |
| APG00582 modified | Seq ID 207 | Alternate start | PF03945 | Endotoxin N | 63 | 292 |
| | | | PF00555 | Endotoxin M | 297 | 504 |
| | | | PF03944 | Endotoxin C | 514 | 651 |
| APG00585 modified | Seq ID 208 | Signal peptide removed | PF03318 | ETX MTX2 | 51 | 286 |
| APG00602 modified | Seq ID 209 | Alternate start | PF14200 | RicinB lectin 2 | 2 | 98 |
| | | | PF05431 | Toxin 10 | 152 | 349 |
| APG00615 modified | Seq ID 210 | Signal peptide removed | PF03945 | Endotoxin N | 82 | 266 |
| | | | PF01473 | CW binding 1 | 384 | 403 |
| | | | PF01473 | CW binding 1 | 405 | 419 |
| APG00617 modified | Seq ID 211 | Alternate start | PF03945 | Endotoxin N | 120 | 369 |
| APG00617 modified | Seq ID 212 | Alternate start and 3' Truncation | PF03945 | Endotoxin N | 120 | 369 |
| | | | PF03944 | Endotoxin C | 611 | 776 |
| APG00626 modified | Seq ID 213 | Alternate start | PF03945 | Endotoxin N | 108 | 300 |
| | | | PF01473 | CW binding 1 | 408 | 425 |
| | | | PF01473 | CW binding 1 | 440 | 454 |
| APG00626 modified | Seq ID 214 | Signal peptide removed | PF03945 | Endotoxin N | 70 | 262 |
| | | | PF01473 | CW binding 1 | 370 | 387 |
| | | | PF01473 | CW binding 1 | 402 | 416 |
| APG00632 modified | Seq ID 215 | Alternate start | PF03945 | Endotoxin N | 49 | 266 |
| | | | PF09131 | Endotoxin mid | 267 | 474 |
| | | | PF03944 | Endotoxin C | 496 | 630 |
| APG00699 modified | Seq ID 216 | Signal peptide removed | PF05791 | Bacillus HBL | 12 | 193 |
| APG00734 modified | Seq ID 217 | Alternate start | PF05431 | Toxin 10 | 264 | 460 |
| APG00750 modified | Seq ID 218 | Alternate start | PF05431 | Toxin 10 | 217 | 412 |
| APG00875 modified | Seq ID 219 | Alternate start | PF12495 | Vip3A N | 12 | 184 |
| | | | PF02018 | CBM 4 9 | 814 | 973 |

TABLE 2-continued

| Summary of PFAM domains in each of SEQ ID NOs: 1-224 | | | | | | |
|---|---|---|---|---|---|---|
| | | Modification | PFAM | Domain | Domain Position | |
| APG ID | Seq ID | Type | Domain | Description | Start | Stop |
| APG00900 modified | Seq ID 220 | Signal peptide removed | PF05791 | Bacillus HBL | 10 | 196 |
| APG00975 modified | Seq ID 221 | Alternate start | PF12495 | Vip3A N | 12 | 188 |
| APG00697 | Seq ID 222 | | PF03318 | ETX MTX2 | 31 | 272 |
| APG00987 | Seq ID 223 | | PF03318 | ETX MTX2 | 17 | 278 |
| APG00987 modified | Seq ID 224 | Alternate start | PF03318 | ETX MTX2 | 11 | 272 |

Recombinant or synthetic nucleic acids encoding the pesticidal polypeptides disclosed herein are also provided. Of particular interest are nucleic acid sequences that have been designed for expression in a plant of interest. That is, the nucleic acid sequence can be optimized for increased expression in a host plant. A pesticidal protein of the invention can be back-translated to produce a nucleic acid comprising codons optimized for expression in a particular host, for example, a crop plant. In another embodiment, the polynucleotides encoding the polypeptides provided herein may be optimized for increased expression in the transformed plant. That is, the polynucleotides can be synthesized using plant-preferred codons for improved expression. See, for example, Campbell and Gowri (1990) *Plant Physiol.* 92:1-11 for a discussion of host-preferred codon usage. Methods are available in the art for synthesizing plant-preferred genes. See, for example, U.S. Pat. Nos. 5,380,831, and 5,436,391, and Murray el al. (1989) *Nucleic Acids Res.* 17:477-498, herein incorporated by reference. Expression of such a coding sequence by the transformed plant (e.g., dicot or monocot) will result in the production of a pesticidal polypeptide and confer increased resistance in the plant to a pest. Recombinant and synthetic nucleic acid molecules encoding the pesticidal proteins of the invention do not include the naturally occurring bacterial sequence encoding the protein.

A “recombinant polynucleotide” or “recombinant nucleic acid” comprises a combination of two or more chemically linked nucleic acid segments which are not found directly joined in nature. By “directly joined” is intended the two nucleic acid segments are immediately adjacent and joined to one another by a chemical linkage. In specific embodiments, the recombinant polynucleotide comprises a polynucleotide of interest or a variant or fragment thereof such that an additional chemically linked nucleic acid segment is located either 5', 3' or internal to the polynucleotide of interest. Alternatively, the chemically-linked nucleic acid segment of the recombinant polynucleotide can be formed by deletion of a sequence. The additional chemically linked nucleic acid segment or the sequence deleted to join the linked nucleic acid segments can be of any length, including for example, 1, 2, 3, 4, 5, 6, 7, 8, 9, 10, 15, 20 or greater nucleotides. Various methods for making such recombinant polynucleotides include chemical synthesis or by the manipulation of isolated segments of polynucleotides by genetic engineering techniques. In specific embodiments, the recombinant polynucleotide can comprise a recombinant DNA sequence or a recombinant RNA sequence. A “fragment of a recombinant polynucleotide or nucleic acid” comprises at least one of a combination of two or more chemically linked amino acid segments which are not found directly joined in nature.

Fragments of a polynucleotide (RNA or DNA) may encode protein fragments that retain activity. In specific embodiments, a fragment of a recombinant polynucleotide or a recombinant polynucleotide construct comprises at least one junction of the two or more chemically linked or operably linked nucleic acid segments which are not found directly joined in nature A fragment of a polynucleotide that encodes a biologically active portion of a polypeptide that retains pesticidal activity will encode at least 25, 30, 40, 50, 60, 70, 75, 80, 90, 100, 110, 120, 125, 130, 140, 150, 160, 170, 175, 180, contiguous amino acids, or up to the total number of amino acids present in a full-length polypeptide as set forth in SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, and/or 224. In specific embodiments, such polypeptide fragments are active fragment, and in still other embodiments, the polypeptide fragment comprises a recombinant polypeptide fragment. As used herein, a fragment of a recombinant polypeptide comprises at least one of a combination of two or more chemically linked amino acid segments which are not found directly joined in nature.

By “Variants” is intended to mean substantially similar sequences. For polynucleotides, a variant comprises a deletion and/or addition of one or more nucleotides at one or more internal sites within the native polynucleotide and/or a substitution of one or more nucleotides at one or more sites in the native polynucleotide. As used herein, a “native” polynucleotide or polypeptide comprises a naturally occurring nucleotide sequence or amino acid sequence, respectively.

Variants of a particular polynucleotide of the invention (i.e., the reference polynucleotide) can also be evaluated by comparison of the percent sequence identity between the polypeptide encoded by a variant polynucleotide and the polypeptide encoded by the reference polynucleotide. Thus, for example, an isolated polynucleotide that encodes a polypeptide with a given percent sequence identity to the polypeptide of SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224 are disclosed. Percent sequence identity between any two polypeptides can be calculated using sequence alignment programs and parameters described elsewhere herein. Where any given pair of polynucleotides of the invention is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99% or more sequence identity to SEQ ID NO: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224.

In other embodiments, the variant of the polynucleotide provided herein differs from the native sequence by at least 1, 2, 3, 4, 5, 6, 7, 8, 9, 10 or more nucleotides.

Variant polynucleotide and proteins also encompass sequences and proteins derived from a mutagenic and recombinogenic procedure such as DNA shuffling. With such a procedure, one or more different pesticidal protein disclosed herein (SEQ ID NOs: 1-224) is manipulated to create a new pesticidal protein possessing the desired properties. In this manner, libraries of recombinant polynucleotides are generated from a population of related sequence polynucleotides comprising sequence regions that have substantial sequence identity and can be homologously recombined in vitro or in vivo. For example, using this approach, sequence motifs encoding a domain of interest may be shuffled between the pesticidal sequences provided herein and other known pesticidal genes to obtain a new gene coding for a protein with an improved property of interest, such as an increased $K_m$ in the case of an enzyme. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458. A "shuffled" nucleic acid is a nucleic acid produced by a shuffling procedure such as any shuffling procedure set forth herein. Shuffled nucleic acids are produced by recombining (physically or virtually) two or more nucleic acids (or character strings), for example in an artificial, and optionally recursive, fashion. Generally, one or more screening steps are used in shuffling processes to identify nucleic acids of interest; this screening step can be performed before or after any recombination step. In some (but not all) shuffling embodiments, it is desirable to perform multiple rounds of recombination prior to selection to increase the diversity of the pool to be screened. The overall process of recombination and selection are optionally repeated recursively. Depending on context, shuffling can refer to an overall process of recombination and selection, or, alternately, can simply refer to the recombinational portions of the overall process.

In one embodiments, a method of obtaining a polynucleotide that encodes an improved polypeptide comprising pesticidal activity is provided, wherein the improved polypeptide has at least one improved property over any one of SEQ ID NOs: 1-224. Such methods can comprises (a) recombining a plurality of parental polynucleotides to produce a library of recombinant polynucleotides encoding recombinant pesticidal polypeptides; (b) screening the library to identify a recombinant polynucleotide that encodes an improved recombinant pesticidal polypeptide that has an enhanced property improved over the parental polynucleotide; (c) recovering the recombinant polynucleotide that encodes the improved recombinant pesticidal polypeptide identified in (b); and, (d) repeating steps (a), (b) and (c) using the recombinant polynucleotide recovered in step (c) as one of the plurality of parental polynucleotides in repeated step (a).

iii. Sequence Comparisons

As used herein, the term "identity" or "percent identity" when used with respect to a particular pair of aligned amino acid sequences, refers to the percent amino acid sequence identity that is obtained by counting the number of identical matches in the alignment and dividing such number of identical matches by the length of the aligned sequences. As used herein, the term "similarity" or "percent similarity" when used with respect to a particular pair of aligned amino acid sequences, refers to the sum of the scores that are obtained from a scoring matrix for each amino acid pair in the alignment divided by the length of the aligned sequences.

Unless otherwise stated, identity and similarity will be calculated by the Needleman-Wunsch global alignment and scoring algorithms (Needleman and Wunsch (1970) *J. Mol. Biol.* 48(3):443-453) as implemented by the "needle" program, distributed as part of the EMBOSS software package (Rice, P., et al. (2000) EMBOSS: The European Molecular Biology Open Software Suite, *Trends in Genetics* 16(6):276-277, versions 6.3.1 available from EMBnet at embnet.org/resource/emboss and emboss.sourceforge.net, among other sources) using default gap penalties and scoring matrices (EBLOSUM62 for protein and EDNAFULL for DNA). Equivalent programs may also be used. By "equivalent program" is intended any sequence comparison program that, for any two sequences in question, generates an alignment having identical nucleotide residue matches and an identical percent sequence identity when compared to the corresponding alignment generated by needle from EMBOSS version 6.3.1.

Additional mathematical algorithms are known in the art and can be utilized for the comparison of two sequences. See, for example, the algorithm of Karlin and Altschul (1990) *Proc. Natl. Acad. Sci. USA* 87:2264, modified as in Karlin and Altschul (1993) *Proc. Natl. Acad. Sci. USA* 90:5873-5877. Such an algorithm is incorporated into the BLAST programs of Altschul et al. (1990) *J. Mol. Biol.* 215:403. BLAST nucleotide searches can be performed with the BLASTN program (nucleotide query searched against nucleotide sequences) to obtain nucleotide sequences homologous to pesticidal-like nucleic acid molecules of the invention, or with the BLASTX program (translated nucleotide query searched against protein sequences) to obtain protein sequences homologous to pesticidal nucleic acid molecules of the invention. BLAST protein searches can be performed with the BLASTP program (protein query searched against protein sequences) to obtain amino acid sequences homologous to pesticidal protein molecules of the invention, or with the TBLASTN program (protein query searched against translated nucleotide sequences) to obtain nucleotide sequences homologous to pesticidal protein molecules of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-Blast can be used to perform an iterated search that detects distant relationships between molecules. See Altschul et al. (1997) supra. When utilizing BLAST, Gapped BLAST, and PSI-Blast programs, the default parameters of the respective programs (e.g., BLASTX and BLASTN) can be used. Alignment may also be performed manually by inspection.

Two sequences are "optimally aligned" when they are aligned for similarity scoring using a defined amino acid substitution matrix (e.g., BLOSUM62), gap existence penalty and gap extension penalty so as to arrive at the highest score possible for that pair of sequences. Amino acid substitution matrices and their use in quantifying the similarity between two sequences are well-known in the art and described, e.g., in Dayhoff et al. (1978) "A model of evolutionary change in proteins." In "Atlas of Protein Sequence and Structure," Vol. 5, Suppl. 3 (ed. M. O. Dayhoff), pp. 345-352. Natl. Biomed. Res. Found., Washington, D.C. and Henikoff et al. (1992) *Proc. Natl. Acad. Sci. USA* 89:10915-10919. The BLOSUM62 matrix is often used as a default scoring substitution matrix in sequence alignment protocols. The gap existence penalty is imposed for the introduction of a single amino acid gap in one of the aligned sequences, and the gap extension penalty is imposed for each additional empty amino acid position inserted into an already opened gap. The alignment is defined by the amino acids positions of each sequence at which the alignment begins and ends, and optionally by the insertion of a gap or multiple gaps in one or both sequences, so as to arrive at the highest possible score. While optimal alignment and scoring can be accomplished manually, the process is facilitated by the use of a computer-implemented alignment algorithm, e.g., gapped BLAST 2.0, described in Altschul et al. (1997) *Nucleic Acids Res.* 25:3389-3402, and made available to the public at the National Center for Biotechnology Information Website (www.ncbi.nlm.nih.gov). Optimal alignments, including multiple alignments, can be prepared using, e.g., PSI-BLAST, available through www.ncbi.nlm.nih.gov and described by Altschul et al. (1997) *Nucleic Acids Res.* 25:3389-3402.

With respect to an amino acid sequence that is optimally aligned with a reference sequence, an amino acid residue "corresponds to" the position in the reference sequence with which the residue is paired in the alignment. The "position" is denoted by a number that sequentially identifies each amino acid in the reference sequence based on its position relative to the N-terminus. For example, in SEQ ID NO: 1 position 1 is L, position 2 is S, position 3 is I, etc. When a test sequence is optimally aligned with SEQ ID NO: 1, a residue in the test sequence that aligns with the I at position 3 is said to "correspond to position 3" of SEQ ID NO: 1. Owing to deletions, insertion, truncations, fusions, etc., that must be taken into account when determining an optimal alignment, in general the amino acid residue number in a test sequence as determined by simply counting from the N-terminal will not necessarily be the same as the number of its corresponding position in the reference sequence. For example, in a case where there is a deletion in an aligned test sequence, there will be no amino acid that corresponds to a position in the reference sequence at the site of deletion. Where there is an insertion in an aligned reference sequence, that insertion will not correspond to any amino acid position in the reference sequence. In the case of truncations or fusions there can be stretches of amino acids in either the reference or aligned sequence that do not correspond to any amino acid in the corresponding sequence.

iv. Antibodies

Antibodies to the polypeptides of the present invention, or to variants or fragments thereof, are also encompassed. Methods for producing antibodies are well known in the art (see, for example, Harlow and Lane (1988) Antibodies: A Laboratory Manual, Cold Spring Harbor Laboratory, Cold Spring Harbor, N.Y.; and U.S. Pat. No. 4,196,265). These antibodies can be used in kits for the detection and isolation of toxin polypeptides. Thus, this disclosure provides kits comprising antibodies that specifically bind to the polypeptides described herein, including, for example, polypeptides having the sequence of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, and/or 224.

II. Pests

The compositions and methods provided herein are useful against a variety of pests. "Pests" includes but is not limited to, insects, fungi, bacteria, nematodes, acarids, protozoan pathogens, animal-parasitic liver flukes, and the like. Pests of particular interest are insect pests, particularly insect pests that cause significant damage to agricultural plants. Insect pests include insects selected from the orders Coleoptera, Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, or nematodes. In non-limiting embodiments, the insect pest may comprise Western corn rootworm, *Diabrotica virgifera virgifera*; Fall armyworm, *Spodoptera frugiperda*; Colorado potato beetle, *Leptinotarsa decemlineata*; Corn earworm, *Helicoverpa zea* (in North America same species attacks cotton and called cotton bollworm); European corn borer, *Ostrinia nubilalis*; Black cutworm, *Agrotis ipsilon*; Diamondback moth, *Plutella xylostella*; Velvetbean caterpillar, *Anticarsia gemmatalis*; Southwestern corn borer, *Diatraea grandiosella*; Cotton bollworm, *Helicoverpa armigera* (found other than USA in rest of the world); Southern green stinkbug, *Nezara viridula*; Green stinkbug, *Chinavia halaris*; Brown marmorated stinkbug, *Halyomorpha halys*; and Brown stinbug, *Euschistus servus, Euschistus heros* (Neotropical brown stink bug and/or soy stink bug); *Piezodorus guildinii* (red-banded stink bug); *Dichelops melacanthus* (no common name) and/or *Dichelops furcatus* (no common name); an aphid, such as a soybean aphid. In other embodiments, the pest comprises a nematode including, but not limited to, *Meloidogyne hapla* (Northern root-knot nematode); *Meloidogyne enterolobii, Meloidogyne arenaria* (peanut root-knot nematode); and/or *Meloidogyne javanica*.

The term "insect pests" as used herein refers to insects and other similar pests such as, for example, those of the order Acari including, but not limited to, mites and ticks. Insect pests of the present invention include, but are not limited to, insects of the order Lepidoptera, e.g. *Achoroia grisella, Acleris gloverana, Acleris variana, Adoxophyes orana, Agrotis ipsilon, Alabama argillacea, Alsophila pometaria, Amyelois transitella, Anagasta kuehniella, Anarsia lineatella, Anisota senatoria, Antheraea pernyi, Anticarsia gemmatalis, Archips* sp., *Argyrotaenia* sp., *Athetis mindara, Bombyx mori, Bucculatrix thurberiella, Cadra cautella, Choristoneura* sp., *Cochylls hospes, Colias eurytheme, Corcyra cephalonica, Cydia latiferreanus, Cydia pomonella, Datana integerrima, Dendrolimus sibericus, Desmiafeneralis, Diaphania hyalinata, Diaphania nitidalis, Diatraea grandiosella, Diatraea saccharalis, Ennomos subsignaria, Eoreuma loftini, Esphestia ehiella, Erannis tilaria, Estigmene acrea, Eulia salubricola, Eupocoellia ambiguella, Eupoecilia ambiguella, Euproctis chrysorrhoea, Euxoa messoria, Galleria mellonella, Grapholita molesta, Harrisina americana, Helicoverpa subflexa, Helicoverpa zea, Heliothis virescens, Hemileuca oliviae, Homoeosoma electellum, Hyphantia cunea, Keiferia lycopersicella, Lambdina fiscellaria fiscellaria, Lambdinafiscellaria lugubrosa, Leucoma salicis, Lobesia botrana, Loxostege sticticalis, Lymantria dispar, Macalla thyrisalis, Malacosoma* sp., *Mamestra brassicae, Mamestra configurata, Manduca quinquemaculata, Manduca sexta, Maruca testulalis, Melanchra picta, Operophtera brumata, Orgyia* sp., *Ostrinia mibilalis, Paleacrita vernata, Papilio cresphontes, Pectinophora gossypiella, Phryganidia calfornica, Phyllonorycter blancardella, Pieris napi, Pieris rapae, Plathypena scabra, Platynotaflouendana, Platynota sthlana, Platyptilia carduidactyla, Plodia interpunctella, Plutella xylostella, Pontia protodice, Pseudaletia unpuncta, Pseudoplasia includens, Sabulodes aegrotata, Schizura concinna, Sitotroga cerealella, Spilonta ocellana, Spodoptera* sp., *Thaurnslopoea pityocampa, Tinsola bisseliella, Trichoplusia hi, Udea rubigalis, Xvlomyges curiails*, and *Yponomeuta* padella.

Insect pests also include insects selected from the orders Diptera, Hymenoptera, Lepidoptera, Mallophaga, Homoptera, Hemiptera, Orthroptera, Thysanoptera, Dermaptera, Isoptera, Anoplura, Siphonaptera, Trichoptera, Coleoptera.

Insect pests of the invention for the major crops include, but are not limited to: Maize: *Ostrinia nubilalis*, European corn borer; *Agrotis ipsilon*, black cutworm; *Helicoverpa zeae*, corn earworm; *Spodoptera frugiperda*, fall armyworm; *Diatraea grandiosella*, southwestern corn borer; *Elasmopalpus lignosellus*, lesser cornstalk borer; *Diatraea saccharalis*, surgarcane borer; western corn rootworm, e.g., *Diabrotica virgfera virgifera*; northern corn rootworm, e.g., *Diabrotica longicornis barberi*; southern corn rootworm, e.g., *Diabrotica undecimpunctata howardi; Melanotus* spp., wireworms; *Cyclocephala borealis*, northern masked chafer (white grub); *Cyclocephala immaculata*, southern masked chafer (white grub); Popillia japonica, Japanese beetle; *Chaetocnema pulicaria*, corn flea beetle; *Sphenophorus maidis*, maize billbug; *Rhopalosiphum maidis*, corn leaf aphid; *Anuraphis maidiradicis*, corn root aphid; *Blissus leucopterus* leucoplerus, chinch bug; *Melanoplus femurrubrum,* redlegged grasshopper; *Melanoplus sanguinipes*, migratory grasshopper; *Hylemya platura*, seedcorn maggot; *Agromyza parvicornis*, corn blotch leafminer; *Anaphothrips obscrurus*, grass *thrips; Solenopsis milesta*, thief ant; *Tetranychus urticae*, two spotted spider mite; Sorghum: *Chilo partellus*, sorghum borer; *Spodoptera frugiperda*, fall armyworm; *Helicoverpa zea*, corn earworm; *Elasmopalpus lignosellus*, leser cornstalk borer; *Feltia subterranea*, granulate cutworm; *Phyllophaga crinita*, white grub; *Eleodes, Conoderus*, and *Aeolus* spp., wireworms; *Oulema melanopus*, cereal leaf beetle; *Chaetocnema pulicaria*, corn flea beetle; *Sphenophorus maidis*, maize billbug; *Rhopalosiphum maidis*; corn leaf aphid; *Sipha flava*, yellow sugarcane aphid; chinch bug, e.g., *Blissus leucopterus leucopterus; Contarinia sorghicola*, sorghum midge; *Tetranychus cinnabarinus*, carmine spider mite; *Tetranychus urticae*, two-spotted spider mite; Wheat: *Pseudaletia unipunctata*, army worm; *Spodoplera frugiperda*, fall armyworm; *Elasmopalpus lignosellus*, lesser cornstalk borer; *Agrotis orthogonia*, pale western cutworm; *Elasmopalpus lignosellus*, lesser cornstalk borer; *Oulema melanopus*, cereal leaf beetle; *Hypera punctata*, clover leaf weevil; southern corn rootworm, e.g., *Diabrotica undecimpunciata howardi*; Russian wheat aphid; *Schizaphis graminum*, greenbug; *Macrosiphum avenae*, English grain aphid; *Melanoplus femurrubrum*, redlegged grasshopper; *Melanoplus differentialis*, differential grasshopper; *Melanoplus sanguinipes*, migratory grasshopper; *Mayetiola destructor*, Hessian fly; *Sitodiplosis mosellana*, wheat midge; *Meromyza americana*, wheat stem maggot; *Hylemya coarciata*, wheat bulb fly; *Frankliniella fusca*, tobacco *thrips; Cephus cinctus*, wheat stem sawfly; *Aceria tulipae*, wheat curl mite; Sunflower: *Cylindrocupturus adspersus*, sunflower stem weevil; *Smicronyx fulus*, red sunflower seed weevil; *Smicronyx sordidus*, gray sunflower seed weevil; *Suleima helianthana*, sunflower bud moth; *Homoeosona electellum*, sunflower moth; *Zygogramma exclamationis*, sunflower beetle; *Bothyrus gibbosus*, carrot beetle; *Neolasioptera murtfeldtiana*, sunflower seed midge; Cotton: *Heliothis virescens*, tobacco budworm; *Helicoverpa zea*, cotton bollworm; *Spodoptera exigua*, beet armyworm; *Pectinophora gossypiella*, pink bollworm; boll weevil, e.g., *Anthonomus grandis; Aphis gossypii*, cotton aphid; *Pseudatomoscelis seriatus*, cotton fleahopper; *Trialeurodes abutilonea*, bandedwinged whitefly; *Lygus lineolaris*, tarnished plant bug; *Melanoplus femurrubrum*, redlegged grasshopper; *Melanoplus differentialis*, differential grasshopper; *Thrips tabaci*, onion *thrips*; Franklinkiellafiusca, tobacco *thrips; Tetratnychus cinnabarinus*, carmine spider mite; *Tetranychus urticae*, two-spotted spider mite; Rice: *Diatraea saccharalis*, sugarcane borer; *Spodoptera frugiperda*, fall armyworm; *Helicoverpa zea*, corn earworm; *Colaspis brunnea*, grape *colaspis; Lissorhoptrus oryzophilus*, rice water weevil; *Sitophilus oryzae*, rice weevil; *Nephotettix nigropictus*, rice leafhoper; chinch bug, e.g., *Blissus leucopterus* leutcopterus; *Acrosternum hilare*, green stink bug; Soybean: *Pseudoplusia includens*, soybean looper; *Anticarsia gemmatalis*, velvetbean caterpillar; *Plathypena scabra*, green cloverworm; *Ostrinia nubilalis*, European corn borer; *Agrotis ipsilon*, black cutworm; *Spodoptera exigua*, beet armyworm; *Heliothis virescens*, tobacco budworm; *Helicoverpa zea*, cotton bollworm; *Epilachna varivestis*, Mexican bean beetle; *Myzus persicae*, green peach aphid; *Empoasca fabae*, potato leafhopper; *Acrostenum hilare*, green stink bug; *Melanoplus femurrubrum*, redlegged grasshopper; *Melanophss differentialis*, differential grasshopper; *Hylemya platura*, seedcorn maggot; *Sericothrips variabilis*, soybean *thrips; Thrips tabaci*, onion *thrips; Tetrantychus turkestani*, strawberry spider mite; *Tetranychus urticae*, two-spotted spider mite; Barley: *Ostrinia nubilalis*, European corn borer; *Agrotis ipsilon*, black cutworm; *Schizaphis graminum*, greenbug; chinch bug, e.g., *Blissus leucopterus leucopterus; Acrostenrnm hilare*, green stink bug; *Euschistus servus*, brown stink bug; *Jylemya platura*, seedcorn maggot; *Mayetiola destructor*, Hessian fly; *Petrobia latens*, brown wheat mite; Oil Seed Rape: *Vrevicoryne brassicae*, cabbage aphid; *Phyllotreta cruciferae*, crucifer flea beetle; *Phyllotreta striolata*, striped flea beetle; *Phyllotreta nemorum*, striped turnip flea beetle; *Meligethes aeneus*, rapeseed beetle; and the pollen beetles *Meligethes rufimanus, Meligethes nigrescens, Meligethes canadianus*, and *Meligethes viridescens*; Potato: *Leptinotarsa decemlineata*, Colorado potato beetle.

The methods and compositions provided herein may be effective against Hemiptera such as *Lygus hesperus, Lygus lineolaris, Lygus pratensis, Lygus rugulipennis Popp, Lygus pabulinus, Calocoris norvegicus, Orthops compestris, Plesiocoris rugicollis, Cyrtopeltis modestus, Cyrtopeltis notatus, Spinagonicus albofasciatus, Diaphnocoris chlorinonis, Labopidicola allii, Pseudatomoscelis seriatus, Adelphocoris rapidus, Poecilocapsus lineatus, Blissus leucopterus, Nysius ericae, Nysius raphanus, Euschistus servus, Nezara viridula,* Eurygaster, Coreidae, Pyrrhocoridae, Tinidae, Blostomatidae, Reduviidae, and Cimicidae. Pests of interest also include *Araecerus fasciculatus*, coffee bean weevil; *Acanthoscelides obtectus*, bean weevil; *Bruchus rufmanus*, broadbean weevil; *Bruchus pisorum*, pea weevil; *Zabrotes subfasciatus*, Mexican bean weevil; *Diabrotica balteata*, banded cucumber beetle; *Cerotoma trifurcata*, bean leaf beetle; *Diabrotica virgifera*, Mexican corn rootworm; *Epitrix cucumeris*, potato flea beetle; *Chaetocnema confinis*, sweet potato flea beetle; *Hypera postica*, alfalfa weevil; *Anthonomus quadrigibbus*, apple curculio; *Sternechus paludatus*, bean stalk weevil; *Hypera brunnipennis*, Egyptian alfalfa weevil; *Sitophilus granaries*, granary weevil; *Craponius inaequalis*, grape curculio; *Sitophilus zeamais*, maize weevil; *Conotrachelus nenuphar*, plum curculio; *Euscepes postfaciatus*, West Indian sweet potato weevil; *Maladera castanea*, Asiatic garden beetle; *Rhizotrogus majalis*, European chafer; *Macrodactylus subspinosus*, rose chafer; *Tribolium confusum*, confused flour beetle; *Tenebrio obscurus*, dark mealworm; *Tribolium castaneum*, red flour beetle; *Tenebrio molitor*, yellow mealworm.

Nematodes include parasitic nematodes such as root-knot, cyst, and lesion nematodes, including *Heterodera* spp., *Meloidogyne* spp., and *Globodera* spp.; particularly members of the cyst nematodes, including, but not limited to, *Heterodera glycines* (soybean cyst nematode); *Heterodera schachtii* (beet cyst nematode); *Heterodera avenae* (cereal cyst nematode); and *Globodera rostochiensis* and *Globodera pailida* (potato cyst nematodes). Lesion nematodes include *Pratylenchus* spp.

Insect pests may be tested for pesticidal activity of compositions of the invention in early developmental stages, e.g., as larvae or other immature forms. The insects may be reared in total darkness at from about 20° C. to about 30° C. and from about 30% to about 70% relative humidity. Bioassays may be performed as described in Czapla and Lang (1990) *J. Econ. Entomol.* 83 (6): 2480-2485. See, also the experimental section herein.

III. Expression Cassettes

Polynucleotides encoding the pesticidal proteins provided herein can be provided in expression cassettes for expression in an organism of interest. The cassette will include 5' and 3' regulatory sequences operably linked to a polynucleotide encoding a pesticidal polypeptide provided herein that allows for expression of the polynucleotide. The cassette may additionally contain at least one additional gene or genetic element to be cotransformed into the organism. Where additional genes or elements are included, the components are operably linked. Alternatively, the additional gene(s) or element(s) can be provided on multiple expression cassettes. Such an expression cassette is provided with a plurality of restriction sites and/or recombination sites for insertion of the polynucleotides to be under the transcriptional regulation of the regulatory regions. The expression cassette may additionally contain a selectable marker gene.

The expression cassette will include in the 5'-3' direction of transcription, a transcriptional and translational initiation region (i.e., a promoter), a pesticidal polynucleotide of the invention, and a transcriptional and translational termination region (i.e., termination region) functional in the organism of interest, i.e., a plant or bacteria. The promoters of the invention are capable of directing or driving expression of a coding sequence in a host cell. The regulatory regions (i.e., promoters, transcriptional regulatory regions, and translational termination regions) may be endogenous or heterologous to the host cell or to each other. As used herein, "heterologous" in reference to a sequence is a sequence that originates from a foreign species, or, if from the same species, is substantially modified from its native form in composition and/or genomic locus by deliberate human intervention. As used herein, a chimeric gene comprises a coding sequence operably linked to a transcription initiation region that is heterologous to the coding sequence.

Convenient termination regions are available from the Ti-plasmid of *A. tumefaciens*, such as the octopine synthase and nopaline synthase termination regions. See also Guerineau el al. (1991) *Mol. Gen. Genet.* 262:141-144; Proudfoot (1991) *Cell* 64:671-674; Sanfacon et al. (1991) *Genes Dev.* 5:141-149; Mogen el al. (1990) *Plant Cell* 2:1261-1272; Munroe et al. (1990) *Gene* 91:151-158; Ballas et al. (1989) *Nucleic Acids Res.* 17:7891-7903; and Joshi et al. (1987) *Nucleic Acids Res.* 15:9627-9639.

Additional regulatory signals include, but are not limited to, transcriptional initiation start sites, operators, activators, enhancers, other regulatory elements, ribosomal binding sites, an initiation codon, termination signals, and the like. See, for example, U.S. Pat. Nos. 5,039,523 and 4,853,331; EP 0480762A2; Sambrook et al. (1992) Molecular Cloning: A Laboratory Manual, ed. Maniatis et al. (Cold Spring Harbor Laboratory Press, Cold Spring Harbor, N.Y.), hereinafter "Sambrook 11"; Davis et al., eds. (1980) Advanced Bacterial Genetics (Cold Spring Harbor Laboratory Press), Cold Spring Harbor, N.Y., and the references cited therein.

In preparing the expression cassette, the various DNA fragments may be manipulated, so as to provide for the DNA sequences in the proper orientation and, as appropriate, in the proper reading frame. Toward this end, adapters or linkers may be employed to join the DNA fragments or other manipulations may be involved to provide for convenient restriction sites, removal of superfluous DNA, removal of restriction sites, or the like. For this purpose, in vitro mutagenesis, primer repair, restriction, annealing, resubstitutions, e.g., transitions and transversions, may be involved.

A number of promoters can be used in the practice of the invention. The promoters can be selected based on the desired outcome. The nucleic acids can be combined with constitutive, inducible, tissue-preferred, or other promoters for expression in the organism of interest. See, for example, promoters set forth in WO 99/43838 and in U.S. Pat. Nos. 8,575,425; 7,790,846; 8,147,856; 8,586832; 7,772,369; 7,534,939; 6,072,050; 5,659,026; 5,608,149; 5,608,144; 5,604,121; 5,569,597; 5,466,785; 5,399,680; 5,268,463; 5,608,142; and 6,177,611; each herein incorporated by reference.

For expression in plants, constitutive promoters also include CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730). Inducible promoters include those that drive expression of pathogenesis-related proteins (PR proteins), which are induced following infection by a pathogen. See, for example, Redolfi et al. (1983) *Neth. J. Plant Pathol.* 89:245-254; Uknes et al. (1992) *Plant Cell* 4:645-656; and Van Loon (1985) *Plant Mol. Virol.* 4:111-116; and WO 99/43819, herein incorporated by reference. Promoters that are expressed locally at or near the site of pathogen infection may also be used (Marineau et al. (1987) *Plant Mol. Biol.* 9:335-342; Matton et al. (1989) *Molecular Plant-Microbe Interactions* 2:325-331; Somsisch et al. (1986) *Proc. Natl. Acad. Sci. USA* 83:2427-2430; Somsisch et al. (1988) *Mol. Gen. Genet.* 2:93-98; and Yang (1996) *Proc. Natl. Acad. Sci. USA* 93:14972-14977; Chen et al. (1996) *Plant J.* 10:955-966; Zhang et al. (1994) *Proc. Natl. Acad. Sci. USA* 91:2507-2511; Warner et al. (1993) *Plant J.* 3:191-201; Siebertz et al. (1989) *Plant Cell* 1:961-968; Cordero et al. (1992) *Physiol. Mol. Plant Path.* 41:189-200; U.S. Pat. No. 5,750,386 (nematode-inducible); and the references cited therein).

Wound-inducible promoters may be used in the constructions of the invention. Such wound-inducible promoters include pin II promoter (Ryan (1990) *Ann. Rev. Phytopath.* 28:425-449; Duan et al. (1996) *Nature Biotechnology* 14:494-498); wun1 and wun2 (U.S. Pat. No. 5,428,148); win1 and win2 (Stanford et al. (1989) *Mol. Gen. Genet.* 215:200-208); systemin (McGurl et al. (1992) *Science* 225:1570-1573); WIP1 (Rohmeier et al. (1993) *Plant Mol. Biol.* 22:783-792; Eckelkamp et al. (1993) *FEBS Letters* 323:73-76); MPI gene (Corderok et al. (1994) *Plant J.* 6(2):141-150); and the like, herein incorporated by reference.

Tissue-preferred promoters for use in the invention include those set forth in Yamamoto et al. (1997) *Plant J.* 12(2):255-265; Kawamata et al. (1997) *Plant Cell Physiol.* 38(7):792-803; Hansen et al. (1997) *Mol. Gen Genet.* 254 (3):337-343; Russell et al. (1997) *Transgenic Res.* 6(2):157-168; Rinehart et al. (1996) *Plant Physiol.* 112(3):1331-1341; Van Camp el al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco el al. (1993) *Plant Mol Biol.* 23(6):1129-1138; Matsuoka et al. (1993) *Proc Natl. Acad. Sci. USA* 90(20):9586-9590: and Guevara-Garcia et al. (1993) *Plant J.* 4(3):495-505.

Leaf-preferred promoters include those set forth in Yamamoto et al. (1997) *Plant J.* 12(2):255-265: Kwon el al. (1994) *Plant Physiol.* 105:357-67; Yamamoto el al. (1994) *Plant Cell Physiol.* 35(5):773-778; Gotor et al. (1993) *Plant J.* 3:509-18; Orozco el al. (1993) *Plant Mol. Biol.* 23(6):1129-1138; and Matsuoka et al. (1993) *Proc. Natl. Acad. Sci. USA* 90(20):9586-9590.

Root-preferred promoters are known and include those in Hire et al. (1992) *Plant Mol. Biol.* 20(2):207-218 (soybean root-specific glutamine synthetase gene); Keller and Baumgartner (1991) *Plant Cell* 3(10):1051-1061 (root-specific control element); Sanger et al. (1990) *Plant Mol. Biol.* 14(3):433-443 (mannopine synthase (MAS) gene of *Agrobacterium tumefaciens*); and Miao et al. (1991) *Plant Cell* 3(1):11-22 (cytosolic glutamine synthetase (GS)); Bogusz et al. (1990) *Plant Cell* 2(7):633-641; Leach and Aoyagi (1991) *Plant Science* (Limerick) 79(1):69-76 (rolC and rolD); Teeri et al. (1989) *EMBO J.* 8(2):343-350; Kuster et al. (1995) *Plant Mol. Biol.* 29(4):759-772 (the VfENOD-GRP3 gene promoter); and, Capana et al. (1994) *Plant Mol. Biol.* 25(4):681-691 (rolB promoter). See also U.S. Pat. Nos. 5,837,876; 5,750,386; 5,633,363; 5,459,252: 5,401,836; 5,110,732; and U.S. Pat. No. 5,023,179.

"Seed-preferred" promoters include both "seed-specific" promoters (those promoters active during seed development such as promoters of seed storage proteins) as well as "seed-germinating" promoters (those promoters active during seed germination). See Thompson et al. (1989) *BioEssays* 10:108. Seed-preferred promoters include, but are not limited to, Cim1 (cytokinin-induced message); cZ19B1 (maize 19 kDa zein); milps (myo-inositol-1-phosphate synthase) (see WO 00/11177 and U.S. Pat. No. 6,225,529). Gamma-zein is an endosperm-specific promoter. Globulin 1 (Glb-1) is a representative embryo-specific promoter. For dicots, seed-specific promoters include, but are not limited to, bean β-phaseolin, napin, β-conglycinin, soybean lectin, cruciferin, and the like. For monocots, seed-specific promoters include, but are not limited to, maize 15 kDa zein, 22 kDa zein, 27 kDa zein, gamma-zein, waxy, shrunken 1, shrunken 2, Globulin 1, etc. See also WO 00/12733, where seed-preferred promoters from end1 and end2 genes are disclosed.

For expression in a bacterial host, promoters that function in bacteria are well-known in the art. Such promoters include any of the known crystal protein gene promoters, including the promoters of any of the pesticidal proteins of the invention, and promoters specific for *B. thuringiensis* sigma factors. Alternatively, mutagenized or recombinant crystal protein-encoding gene promoters may be recombinantly engineered and used to promote expression of the novel gene segments disclosed herein.

The expression cassette can also comprise a selectable marker gene for the selection of transformed cells. Selectable marker genes are utilized for the selection of transformed cells or tissues. Marker genes include genes encoding antibiotic resistance, such as those encoding neomycin phosphotransferase II (NEO) and hygromycin phosphotransferase (HPT), as well as genes conferring resistance to herbicidal compounds, such as glufosinate ammonium, bromoxynil, imidazolinones, and 2,4-dichlorophenoxyacetate (2,4-D). Additional selectable markers are known and any can be used in the practice of the invention. See, for example, PCT/US2015/066648, filed on Dec. 18, 2015, herein incorporated by reference in its entirety, which discloses glufosinate resistance sequences that can be employed as selectable markers.

IV. Methods, Host Cells and Plant Cells

As indicated, DNA constructs comprising nucleotide sequences encoding the pesticidal proteins or active variants or fragment thereof can be used to transform plants of interest or other organisms of interest. Methods for transformation involve introducing a nucleotide construct into a plant. By "introducing" is intended to introduce the nucleotide construct to the plant or other host cell in such a manner that the construct gains access to the interior of a cell of the plant or host cell. The methods of the invention do not require a particular method for introducing a nucleotide construct to a plant or host cell, only that the nucleotide construct gains access to the interior of at least one cell of the plant or the host organism. Methods for introducing nucleotide constructs into plants and other host cells are known in the art including, but not limited to, stable transformation methods, transient transformation methods, and virus-mediated methods.

The methods result in a transformed organism, such as a plant, including whole plants, as well as plant organs (e.g., leaves, stems, roots, etc.), seeds, plant cells, propagules, embryos and progeny of the same. Plant cells can be differentiated or undifferentiated (e.g. callus, suspension culture cells, protoplasts, leaf cells, root cells, phloem cells, pollen).

"Transgenic plants" or "transformed plants" or "stably transformed" plants or cells or tissues refers to plants that have incorporated or integrated a polynucleotide encoding at least one pesticidal polypeptide of the invention. It is recognized that other exogenous or endogenous nucleic acid sequences or DNA fragments may also be incorporated into the plant cell. *Agrobacterium*- and biolistic-mediated transformation remain the two predominantly employed approaches. However, transformation may be performed by infection, transfection, microinjection, electroporation, microprojection, biolistics or particle bombardment, electroporation, silica/carbon fibers, ultrasound mediated, PEG mediated, calcium phosphate co-precipitation, polycation DMSO technique, DEAE dextran procedure, Agro and viral mediated (Caulimoriviruses, Geminiviruses, RNA plant viruses), liposome mediated and the like.

Transformation protocols as well as protocols for introducing polypeptides or polynucleotide sequences into plants may vary depending on the type of plant or plant cell, i.e., monocot or dicot, targeted for transformation. Methods for transformation are known in the art and include those set forth in U.S. Pat. Nos. 8,575,425; 7,692,068; 8,802,934; 7,541,517; each of which is herein incorporated by reference. See, also, Rakoczy-Trojanowska, M. (2002) *Cell Mol Biol Lett.* 7:849-858; Jones et al. (2005) *Plant Methods* 1:5; Rivera et al. (2012) *Physics of Life Reviews* 9:308-345; Bartlett et al. (2008) *Plant Methods* 4:1-12; Bates, G. W. (1999) *Methods in Molecular Biology* 111:359-366; Binns and Thomashow (1988) *Annual Reviews in Microbiology* 42:575-606; Christou, P. (1992) *The Plant Journal* 2:275-281; Christou, P. (1995) *Euphytica* 85:13-27; Tzfira et al. (2004) *TRENDS in Genetics* 20:375-383; Yao et al. (2006) *Journal of Experimental Botany* 57:3737-3746: Zupan and Zambryski (1995) *Plant Physiology* 107:1041-1047; Jones et al. (2005) *Plant Methods* 1:5.

Transformation may result in stable or transient incorporation of the nucleic acid into the cell. "Stable transformation" is intended to mean that the nucleotide construct introduced into a host cell integrates into the genome of the host cell and is capable of being inherited by the progeny thereof. "Transient transformation" is intended to mean that a polynucleotide is introduced into the host cell and does not integrate into the genome of the host cell.

Methods for transformation of chloroplasts are known in the art. See, for example, Svab et al. (1990) *Proc. Natl. Acad. Sci. USA* 87:8526-8530; Svab and Maliga (1993) *Proc. Natl. Acad. Sci. USA* 90:913-917; Svab and Maliga (1993) *EMBO J.* 12:601-606. The method relies on particle gun delivery of DNA containing a selectable marker and targeting of the DNA to the plastid genome through homologous recombination. Additionally, plastid transformation can be accomplished by transactivation of a silent plastid-borne transgene by tissue-preferred expression of a nuclear-encoded and plastid-directed RNA polymerase. Such a system has been reported in McBride et al. (1994) *Proc. Natl. Acad. Sci. USA* 91:7301-7305.

The cells that have been transformed may be grown into plants in accordance with conventional ways. See, for example, McCormick et al. (1986) *Plant Cell Reports* 5:81-84. These plants may then be grown, and either pollinated with the same transformed strain or different strains, and the resulting hybrid having constitutive expression of the desired phenotypic characteristic identified. Two or more generations may be grown to ensure that expression of the desired phenotypic characteristic is stably maintained and inherited and then seeds harvested to ensure expression of the desired phenotypic characteristic has been achieved. In this manner, the present invention provides transformed seed (also referred to as "transgenic seed") having a nucleotide construct of the invention, for example, an expression cassette of the invention, stably incorporated into their genome.

In specific embodiments, the sequences provide herein can be targeted to specific cite within the genome of the host cell or plant cell. Such methods include, but are not limited to, meganucleases designed against the plant genomic sequence of interest (D'Halluin et al. 2013 *Plant Biotechnol J*); CRISPR-Cas9, TALENs, and other technologies for precise editing of genomes (Feng, et al. (2013) *Cell Research* 23:1229-1232; Podevin, et al. (2013) *Trends Biotechnology*, online publication; Wei et al. (2013) *J Gen Genomics*; Zhang et al. (2013) WO 2013/026740); Cre-lox site-specific recombination (Dale et al. (1995) *Plant J* 7:649-659; Lyznik, et al. (2007) *Transgenic Plant J* 1.1-9; FLP-FRT recombination (Li et al. (2009) *Plant Physiol* 151:1087-1095); Bxb1-mediated integration (Yau et al. *Plant J* (2011) 701:147-166); zinc-finger mediated integration (Wright et al. (2005) *Plant J* 44:693-705); Cai et al. (2009) *Plant Mol Biol* 69:699-709); and homologous recombination (Lieberman-Lazarovich and Levy (2011) *Methods Mol Biol* 701: 51-65); Puchta (2002) *Plant Mol Biol* 48:173-182).

The sequence provided herein may be used for transformation of any plant species, including, but not limited to, monocots and dicots. Examples of plants of interest include, but are not limited to, corn (maize), sorghum, wheat, sunflower, tomato, crucifers, peppers, potato, cotton, rice, soybean, sugarbeet, sugarcane, tobacco, barley, and oilseed rape, *Brassica* sp., alfalfa, rye, millet, safflower, peanuts, sweet potato, cassaya, coffee, coconut, pineapple, citrus trees, cocoa, tea, banana, avocado, fig, guava, mango, olive, *Papaya*, cashew, macadamia, almond, oats, vegetables, ornamentals, and conifers.

Vegetables include, but are not limited to, tomatoes, lettuce, green beans, lima beans, peas, and members of the genus Curcumis such as cucumber, cantaloupe, and musk melon. Ornamentals include, but are not limited to, azalea, *Hydrangea*, hibiscus, roses, tulips, daffodils, petunias, carnation, poinsettia, and *Chrysanthemum*. Preferably, plants of the present invention are crop plants (for example, maize, sorghum, wheat, sunflower, tomato, crucifers, peppers, potato, cotton, rice, soybean, sugarbeet, sugarcane, tobacco, barley, oilseed rape, etc.).

As used herein, the term plant includes plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides. Further provided is a processed plant product or byproduct that retains the sequences disclosed herein, including for example, soymeal.

In another embodiment, the genes encoding the pesticidal proteins can be used to transform insect pathogenic organisms. Such organisms include baculoviruses, fungi, protozoa, bacteria, and nematodes. Microorganism hosts that are known to occupy the "phytosphere" (phylloplane, phyllosphere, rhizosphere, and/or rhizoplana) of one or more crops of interest may be selected. These microorganisms are selected so as to be capable of successfully competing in the particular environment with the wild-type microorganisms, provide for stable maintenance and expression of the gene expressing the pesticidal protein, and desirably, provide for improved protection of the pesticide from environmental degradation and inactivation.

Such microorganisms include archaea, bacteria, algae, and fungi. Of particular interest are microorganisms such as bacteria, e.g., *Bacillus, Pseudomonas, Erwinia, Serratia, Klebsiella, Xanthomonas, Streptomyces, Rhizobium, Rhodopseudomonas, Methylius, Agrobacterium, Acetobacter, Lactobacillus, Arthrobacter, Azotobacter, Leuconostoc*, and *Alcaligenes*. Fungi include yeast, e.g., *Saccharomyces, Cryptococcus, Kluyveromyces, Sporobolomyces, Rhodotorula*, and *Aureobasidium*. Of particular interest are such phytosphere bacterial species as *Pseudomonas syringae, Pseudomonas aeruginosa, Pseudomonas fluorescens, Serratia marcescens, Acetobacter xylinum, Agrobacteria, Rhodopseudomonas spheroides, Xanthomonas campestris, Rhizobium melioti, Alcaligenes entrophus, Clavibacter xyli* and *Azotobacter vinlandir* and phytosphere yeast species such as *Rhodotorula rubra, R glutinis, R. marina, R. aurantiaca, Cryptococcus albidus, C. diffluens, C. laurentii, Saccharomyces rosei, S. pretoriensis, S. cerevisiae, Sporobolomyces rosues, S. odorus, Kluyveromyces veronae, Aureobasidium pollulans, Bacillus thuringiensis, Escherichia coli, Bacillus subtilis*, and the like.

Illustrative prokaryotes, both Gram-negative and gram-positive, include Enterobacteriaceae, such as *Escherichia, Erwinia, Shigella, Salmonella*, and *Proteus*; Bacillaceae; Rhizobiceae, such as *Rhizobium*; Spirillaceae, such as photobacterium, *Zymomonas, Serratia, Aeromonas, Vibrio, Desulfovibrio*, Spirillum; Lactobacillaceae; Pseudomonadaceae, such as *Pseudomonas* and *Acetobacter*; Azotobacteraceae and Nitrobacteraceae. Fungi include Phycomycetes and Ascomycetes, e.g., yeast, such as *Saccharomyces* and *Schizosaccharomyces*; and Basidiomycetes yeast, such as *Rhodotorula, Aureobasidium, Sporobolomyces*, and the like.

Genes encoding pesticidal proteins can be introduced by means of electrotransformation, PEG induced transformation, heat shock, transduction, conjugation, and the like. Specifically, genes encoding the pesticidal proteins can be cloned into a shuttle vector, for example, pHT3101 (Lerecius et al. (1989) *FFMS Microbiol. Letts.* 60: 211-218. The shuttle vector pHT3101 containing the coding sequence for the particular pesticidal protein gene can, for example, be transformed into the root-colonizing *Bacillus* by means of electroporation (Lerecius et al. (1989) *FEMS Microbiol. Letts.* 60: 211-218).

Expression systems can be designed so that pesticidal proteins are secreted outside the cytoplasm of gram-negative bacteria by fusing an appropriate signal peptide to the amino-terminal end of the pesticidal protein. Signal peptides recognized by *E. coli* include the OmpA protein (Ghrayeb et al. (1984) *EMBO J,* 3: 2437-2442).

Pesticidal proteins and active variants thereof can be fermented in a bacterial host and the resulting bacteria processed and used as a microbial spray in the same manner that *Bacillus thuringiensis* strains have been used as insecticidal sprays. In the case of a pesticidal protein(s) that is secreted from *Bacillus*, the secretion signal is removed or mutated using procedures known in the art. Such mutations and/or deletions prevent secretion of the pesticidal protein(s) into the growth medium during the fermentation process. The pesticidal proteins are retained within the cell, and the cells are then processed to yield the encapsulated pesticidal proteins.

Alternatively, the pesticidal proteins are produced by introducing heterologous genes into a cellular host. Expression of the heterologous gene results, directly or indirectly, in the intracellular production and maintenance of the pesticide. These cells are then treated under conditions that prolong the activity of the toxin produced in the cell when the cell is applied to the environment of target pest(s). The resulting product retains the toxicity of the toxin. These naturally encapsulated pesticidal proteins may then be formulated in accordance with conventional techniques for application to the environment hosting a target pest, e.g., soil, water, and foliage of plants. See, for example U.S. Pat. No. 6,468,523 and U.S. Publication No. 20050138685, and the references cited therein. In the present invention, a transformed microorganism (which includes whole organisms, cells, spore(s), pesticidal protein(s), pesticidal component(s), pest-impacting component(s), mutant(s), living or dead cells and cell components, including mixtures of living and dead cells and cell components, and including broken cells and cell components) or an isolated pesticidal protein can be formulated with an acceptable carrier into a pesticidal or agricultural composition(s) that is, for example, a suspension, a solution, an emulsion, a dusting powder, a dispersible granule, a wettable powder, and an emulsifiable concentrate, an aerosol, an impregnated granule, an adjuvant, a coatable paste, and also encapsulations in, for example, polymer substances.

Agricultural compositions may comprise a polypeptide, a recombinogenic polypeptide or a variant or fragment thereof, as disclosed herein. The agricultural composition disclosed herein may be applied to the environment of a plant or an area of cultivation, or applied to the plant, plant part, plant cell, or seed.

Such compositions disclosed above may be obtained by the addition of a surface-active agent, an inert carrier, a preservative, a humectant, a feeding stimulant, an attractant, an encapsulating agent, a binder, an emulsifier, a dye, a UV protectant, a buffer, a flow agent or fertilizers, micronutrient donors, or other preparations that influence plant growth. One or more agrochemicals including, but not limited to, herbicides, insecticides, fungicides, bactericides, nematicides, molluscicides, acaracides, plant growth regulators, harvest aids, and fertilizers, can be combined with carriers, surfactants or adjuvants customarily employed in the art of formulation or other components to facilitate product handling and application for particular target pests. Suitable carriers and adjuvants can be solid or liquid and correspond to the substances ordinarily employed in formulation technology, e.g., natural or regenerated mineral substances, solvents, dispersants, wetting agents, tackifiers, binders, or fertilizers. The active ingredients of the present invention are normally applied in the form of compositions and can be applied to the crop area, plant, or seed to be treated. For example, the compositions of the present invention may be applied to grain in preparation for or during storage in a grain bin or silo, etc. The compositions of the present invention may be applied simultaneously or in succession with other compounds. Methods of applying an active ingredient of the present invention or an agrochemical composition of the present invention that contains at least one of the pesticidal proteins produced by the bacterial strains of the present invention include, but are not limited to, foliar application, seed coating, and soil application. The number of applications and the rate of application depend on the intensity of infestation by the corresponding pest.

Suitable surface-active agents include, but are not limited to, anionic compounds such as a carboxylate of, for example, a metal; a carboxylate of a long chain fatty acid; an N-acylsarcosinate; mono or di-esters of phosphoric acid with fatty alcohol ethoxylates or salts of such esters; fatty alcohol sulfates such as sodium dodecyl sulfate, sodium octadecyl sulfate or sodium cetyl sulfate; ethoxylated fatty alcohol sulfates; ethoxylated alkylphenol sulfates; lignin sulfonates; petroleum sulfonates; alkyl aryl sulfonates such as alkyl-benzene sulfonates or lower alkylnaphtalene sulfonates, e.g., butyl-naphthalene sulfonate: salts of sulfonated naphthalene-formaldehyde condensates: salts of sulfonated phenol-formaldehyde condensates; more complex sulfonates such as the amide sulfonates, e.g., the sulfonated condensation product of oleic acid and N-methyl taurine; or the dialkyl sulfosuccinates, e.g., the sodium sulfonate of dioctyl succinate. Non-ionic agents include condensation products of fatty acid esters, fatty alcohols, fatty acid amides or fatty-alkyl- or alkenyl-substituted phenols with ethylene oxide, fatty esters of polyhydric alcohol ethers, e.g., sorbitan fatty acid esters, condensation products of such esters with ethylene oxide, e.g., polyoxyethylene sorbitar fatty acid esters, block copolymers of ethylene oxide and propylene oxide, acetylenic glycols such as 2,4,7,9-tetraethyl-5-decyn-4,7-diol, or ethoxylated acetylenic glycols. Examples of a cationic surface-active agent include, for instance, an aliphatic mono-, di-, or polyamine such as an acetate, naphthenate or oleate; or oxygen-containing amine such as an amine oxide of polyoxyethylene alkylamine; an amide-linked amine prepared by the condensation of a carboxylic acid with a di- or polyamine; or a quaternary ammonium salt.

Examples of inert materials include but are not limited to inorganic minerals such as kaolin, phyllosilicates, carbonates, sulfates, phosphates, or botanical materials such as cork, powdered corncobs, peanut hulls, rice hulls, and walnut shells.

The compositions of the present invention can be in a suitable form for direct application or as a concentrate of primary composition that requires dilution with a suitable quantity of water or other diluant before application. The pesticidal concentration will vary depending upon the nature of the particular formulation, specifically, whether it is a concentrate or to be used directly. The composition contains 1 to 98% of a solid or liquid inert carrier, and 0 to 50% or 0.1 to 50% of a surfactant. These compositions will be administered at the labeled rate for the commercial product, for example, about 0.01 lb-5.0 lb. per acre when in dry form and at about 0.01 pts.-10 pts. per acre when in liquid form.

In a further embodiment, the compositions, as well as the transformed microorganisms and pesticidal proteins, provided herein can be treated prior to formulation to prolong the pesticidal activity when applied to the environment of a target pest as long as the pretreatment is not deleterious to the pesticidal activity. Such treatment can be by chemical and/or physical means as long as the treatment does not deleteriously affect the properties of the composition(s). Examples of chemical reagents include but are not limited to halogenating agents; aldehydes such as formaldehyde and glutaraldehyde; anti-infectives, such as zephiran chloride; alcohols, such as isopropanol and ethanol; and histological fixatives, such as Bouin's fixative and Helly's fixative (see, for example, Humason (1967) *Animal Tissue Techniques* (W.H. Freeman and Co.).

In one aspect, pests may be killed or reduced in numbers in a given area by application of the pesticidal proteins of the invention to the area. Alternatively, the pesticidal proteins may be prophylactically applied to an environmental area to prevent infestation by a susceptible pest. Preferably the pest ingests, or is contacted with, a pesticidally-effective amount of the polypeptide. By "pesticidally-effective amount" is intended an amount of the pesticide that is able to bring about death to at least one pest, or to noticeably reduce pest growth, feeding, or normal physiological development. This amount will vary depending on such factors as, for example, the specific target pests to be controlled, the specific environment, location, plant, crop, or agricultural site to be treated, the environmental conditions, and the method, rate, concentration, stability, and quantity of application of the pesticidally-effective polypeptide composition. The formulations or compositions may also vary with respect to climatic conditions, environmental considerations, and/or frequency of application and/or severity of pest infestation.

The active ingredients are normally applied in the form of compositions and can be applied to the crop area, plant, or seed to be treated. Methods are therefore provided for providing to a plant, plant cell, seed, plant part or an area of cultivation, an effective amount of the agricultural composition comprising the polypeptide, recombinogenic polypeptide or an active variant or fragment thereof. By "effective amount" is intended an amount of a protein or composition sufficient to kill or control the pest or result in a noticeable reduction in pest growth, feeding, or normal physiological development. Such decreases in pest numbers, pest growth, pest feeding or pest normal development can comprise any statistically significant decrease, including, for example a decrease of about 5%, 10%, 15%, 20%, 25%, 30%, 35%, 40%, 45%, 50%, 55%, 60%, 65%, 70%, 75%, 85%, 90%, 95% or greater. For example, the compositions may be applied to grain in preparation for or during storage in a grain bin or silo, etc. The compositions may be applied simultaneously or in succession with other compounds. Methods of applying an active ingredient or an agrochemical composition comprising at least one of the polypeptides, recombinogenic polypeptides or variants or fragments thereof as disclosed herein, include but are not limited to, foliar application, seed coating, and soil application.

Methods for increasing plant yield are provided. The methods comprise providing a plant or plant cell expressing a polynucleotide encoding the pesticidal polypeptide sequence disclosed herein and growing the plant or a seed thereof in a field infested with (or susceptible to infestation by) a pest against which said polypeptide has pesticidal activity. In some embodiments, the polypeptide has pesticidal activity against a lepidopteran, coleopteran, dipteran, hemipteran, or nematode pest, and said field is infested with a lepidopteran, hemipteran, coleopteran, dipteran, or nematode pest. As defined herein, the "yield" of the plant refers to the quality and/or quantity of biomass produced by the plant. By "biomass" is intended any measured plant product. An increase in biomass production is any improvement in the yield of the measured plant product. Increasing plant yield has several commercial applications. For example, increasing plant leaf biomass may increase the yield of leafy vegetables for human or animal consumption. Additionally, increasing leaf biomass can be used to increase production of plant-derived pharmaceutical or industrial products. An increase in yield can comprise any statistically significant increase including, but not limited to, at least a 1% increase, at least a 3% increase, at least a 5% increase, at least a 10% increase, at least a 20% increase, at least a 30%, at least a 50%, at least a 70%, at least a 100% or a greater increase in yield compared to a plant not expressing the pesticidal sequence. In specific methods, plant yield is increased as a result of improved pest resistance of a plant expressing a pesticidal protein disclosed herein. Expression of the pesticidal protein results in a reduced ability of a pest to infest or feed.

The plants can also be treated with one or more chemical compositions, including one or more herbicide, insecticides, or fungicides.

Non-limiting embodiments include:

Embodiment 1. An isolated polypeptide having insecticidal activity, comprising (a) a polypeptide comprising an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224; or (b) a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224.

Embodiment 2. The polypeptide of embodiment 1, wherein said polypeptide comprises the amino acid sequence set forth in SEQ ID Nos. 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224.

Embodiment 3. The polypeptide of embodiment 2, further comprising heterologous amino acid sequences.

Embodiment 4. A composition comprising the polypeptide of at least one of embodiments 1, 2, 3.

Embodiment 5. A recombinant nucleic acid molecule that encodes the polypeptide of embodiments 1 or 2, wherein said recombinant nucleic acid molecule is not the naturally occurring sequence encoding said polypeptide.

Embodiment 6. The recombinant nucleic acid of embodiment 5, wherein said nucleic acid molecule is a synthetic sequence that has been designed for expression in a plant.

Embodiment 7. The recombinant nucleic acid molecule of embodiments 5 or 6, wherein said nucleic acid molecule is operably linked to a promoter capable of directing expression in a plant cell.

Embodiment 8. The recombinant nucleic acid molecule of embodiments 5 or 6, wherein said nucleic acid molecule is operably linked to a promoter capable of directing expression in a bacteria.

Embodiment 9. A host cell that contains the recombinant nucleic acid molecule of any one of embodiments 5-8.

Embodiment 10. The host cell of embodiment 9, wherein said host cell is a bacterial host cell.

Embodiment 11. A DNA construct comprising a promoter that drives expression in a plant cell operably linked to a recombinant nucleic acid molecule comprising:

(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224.

Embodiment 12. The DNA construct of embodiment 11, wherein said nucleotide sequence is a synthetic DNA sequence that has been designed for expression in a plant.

Embodiment 13. A vector comprising the DNA construct of embodiment 11.

Embodiment 14. A host cell that contains the DNA construct of embodiments 11 or 12 or the vector of embodiment 13.

Embodiment 15. The host cell of embodiment 14, wherein the host cell is a plant cell.

Embodiment 16. A transgenic plant comprising the host cell of embodiment 14 or 15.

Embodiment 17. A composition comprising the host cell of embodiment 9, 10, 14, or 15.

Embodiment 18. The composition of embodiment 17, wherein said composition is selected from the group consisting of a powder, dust, pellet, granule, spray, emulsion, colloid, and solution.

Embodiment 19. The composition of embodiment 17, wherein said composition comprises from about 1% to about 99% by weight of said polypeptide.

Embodiment 20. A method for controlling a pest population comprising contacting said population with a pesticidal-effective amount of the composition of any one of embodiments 17-19.

Embodiment 21. A method for killing a pest population comprising contacting said population with a pesticidal-effective amount of the composition of any one of embodiments 17-19.

Embodiment 22. A method for producing a polypeptide with pesticidal activity, comprising culturing the host cell of embodiment 9, 10, 14, or 15 under conditions in which the nucleic acid molecule encoding the polypeptide is expressed.

Embodiment 23. A plant having stably incorporated into its genome a DNA construct comprising a nucleotide sequence that encodes a protein having pesticidal activity, wherein said nucleotide sequence comprises:

(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224.

Embodiment 24. A transgenic seed of the plant of embodiment 23.

Embodiment 25. A method for protecting a plant from an insect pest, comprising expressing in a plant or cell thereof a nucleotide sequence that encodes a pesticidal polypeptide, wherein said nucleotide sequence comprising:

(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224.

Embodiment 26. The method of embodiment 25, wherein said plant produces a pesticidal polypeptide having pesticidal against at least one of a lepidopteran pest or a coleopteran pest.

Embodiment 27. A method for increasing yield in a plant comprising growing in a field a plant or seed thereof having stably incorporated into its genome a DNA construct comprising a promoter that drives expression in a plant operably linked to a nucleotide sequence that encodes a pesticidal polypeptide, wherein said nucleotide sequence comprises:

(a) a nucleotide sequence that encodes a polypeptide comprising the amino acid sequence of any one of SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224; or, (b) a nucleotide sequence that encodes a polypeptide comprising an amino acid sequence having at least the percent sequence identity set forth in Table 1 to an amino acid sequence selected from the group consisting of sequences set forth in SEQ ID NOs: 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, 222, 223, or 224.

Embodiment 28. A method of obtaining a polynucleotide that encodes an improved polypeptide comprising pesticidal activity is provided, wherein the improved polypeptide has at least one improved property over any one of SEQ ID NOs: 1-224 comprising:

(a) recombining a plurality of parental polynucleotides comprising SEQ ID NO: 1-224 or an active variant or fragment thereof to produce a library of recombinant polynucleotides encoding recombinant pesticidal polypeptides;

(b) screening the library to identify a recombinant polynucleotide that encodes an improved recombinant pesticidal polypeptide that has an enhanced property improved over the parental polynucleotide;

(c) recovering the recombinant polynucleotide that encodes the improved recombinant pesticidal polypeptide identified in (b); and, (d) repeating steps (a), (b), and (c) using the recombinant polynucleotide recovered in step (c) as one of the plurality of parental polynucleotides in repeated step (a).

The following examples are offered by way of illustration and not by way of limitation.

EXPERIMENTAL

Experiment 1: Discovery of Novel Genes by Sequencing and DNA Analysis

Microbial cultures were grown in liquid culture in standard laboratory media. Cultures were grown to saturation (16 to 24 hours) before DNA preparation. DNA was extracted from bacterial cells by detergent lysis, followed by binding to a silica matrix and washing with an ethanol buffer. Purified DNA was eluted from the silica matrix with a mildly alkaline aqueous buffer.

DNA for sequencing was tested for purity and concentration by spectrophotometry. Sequencing libraries were prepared using the Nextera XT library preparation kit according to the manufacturer's protocol. Sequence data was generated on a HiSeq 2000 according to the Illumina HiSeq 2000 System User Guide protocol.

Sequencing reads were assembled into draft genomes using the CLC Bio Assembly Cell software package. Following assembly, gene calls were made by several methods and resulting gene sequences were interrogated to identify novel homologs of pesticidal genes. Novel genes were identified by BLAST, by domain composition, and by pair-wise alignment versus a target set of pesticidal genes. A summary of such sequences is set forth in Table 1.

Genes identified in the homology search were amplified from bacterial DNA by PCR and cloned into bacterial expression vectors containing fused in-frame purification tags. Cloned genes were expressed in *E. coli* and purified by column chromatography. Purified proteins were assessed in insect diet bioassay studies to identify active proteins.

Insect diet bioassays were performed using a wheat germ and agar artificial diet to which purified protein were applied as a surface treatment. Insect larvae were applied to treated diet and monitored for mortality.

Insect diet bioassays were performed using a sucrose liquid diet contained in a membrane sachet to which purified protein was added. Insect nymphs were allowed to feed on the diet sachet and were monitored for mortality. Insects tested in bioassays included the Brown Stink Bug (BSB), *Euschistus servus*, and the Southern Green Stink Bug (SGSB), *Nezara viridula.*

Example 2. Heterologous Expression in *E. coli*

Each open reading frame set forth in Tables 3 and 4 was cloned into an *E. coli* expression vector containing a maltose binding protein (pMBP). The expression vector was transformed into BL21*RIPL. An LB culture supplemented with carbenicillin was inoculated with a single colony and grown overnight at 37° C. using 0.5% of the overnight culture, a fresh culture was inoculated and grown to logarithmic phase at 37° C. The culture was induced using 250 mM IPTG for 18 hours at 16° C. The cells were pelleted and resuspended in 10 mM Tris pH7.4 and 150 mM NaCl supplemented with protease inhibitors. The protein expression was evaluated by SDS-PAGE.

Example 3. Pesticidal Activity Against Coleopteran and Lepidoptera

Protein Expression: Each sequence set forth in Table 3 was expressed in *E. coli* as described in Example 2. 400 mL of LB was inoculated and grown to an OD600 of 0.6. The culture was induced with 0.25 mM IPTG overnight at 16° C. The cells were spun down and the cell pellet was resuspend in 5 mL of buffer. The resuspension was sonicated for 2 min on ice.

Bioassay: Fall army worm (FAW), corn ear worm (CEW), European corn borer (ECB) southwestern corn borer (SWCB) and diamond backed moth (DBM or Px) eggs were purchased from a commercial insectary (Benzon Research Inc., Carlisle, PA). The FAW, CEW, ECB and BCW eggs were incubated to the point that eclosion would occur within 12 hrs of the assay setup. SWCB and DBM were introduced to the assay as neonate larvae. Assays were carried out in 24-well trays containing multispecies lepidopteran diet (Southland Products Inc., Lake Village, AR). Samples of the sonicated lysate were applied to the surface of the diet (diet overlay) and allowed to evaporate and soak into the diet. For CEW, FAW, BCW, ECB and SWCB, a 125 μl of sonicated lysate was added to the diet surface and dried. For DBM, 50 μl of a 1:2 dilution of sonicated lysate was added to the diet surface. The bioassay plates were sealed with a plate sealing film vented with pin holes. The plates were incubated at 26° C. at 65% relative humidity (RH) on a 16:8 day:night cycle in a Percival for 5 days. The assays were assessed for level of mortality, growth inhibition and feeding inhibition.

For the western corn rootworm bioassay, the protein construct/lysate was evaluated in an insect bioassay by dispensing 60 μl volume on the top surface of diet in well/s of 24-well plate (Cellstar, 24-well, Greiner Bio One) and allowed to dry. Each well contained 500 μl diet (Marrone et al., 1985). Fifteen to twenty neonate larvae were introduced in each well using a fine tip paint brush and the plate was covered with membrane (Viewseal, Greiner Bio One). The bioassay was stored at ambient temperature and scored for mortality, and/or growth/feeding inhibition at day 4.

For Colorado Potato Beetle (CPB) a cork bore size No. 8 leaf disk was excised from potato leaf and was dipped in the protein construct/lysate until thoroughly wet and placed on top of filter disk (Millipore, glass fiber filter, 13 mm). 60 μl dH2O was added to each filter disk and placed in each well of 24-well plate (Cellstar, 24-well, Greiner Bio One). The leaf disk was allowed to dry and five to seven first instar larvae were introduced in each well using a fine tip paint brush. The plate was covered with membrane (Viewseal, Greiner Bio One) and small hole was punctured in each well of the membrane. The construct was evaluated with four replicates, and scored for mortality and leaf damage on day 3.

Table 3 provides a summary of pesticidal activity against coleopteran and lepidoptera of the various sequences. Table code: "–" indicates no activity seen; "+" indicates pesticidal activity; "NT" indicates not tested; "S" indicates stunt; "SS" indicates slight stunt; "LF" indicates low feeding, "M" indicates mortality.

TABLE 3

Summary of Pesticidal Activity Coleopteran against and Lepidoptera.

| APG | Seq ID | FAW | CEW | BCW | ECB | SWCB | CPB | Px | WCR Mortality (%) |
|---|---|---|---|---|---|---|---|---|---|
| APG00078 | 2 | — | S | — | — | — | NT | NT | 0-50% |

Example 4. Pesticidal Activity Against Hemipteran

Protein Expression: Each of the sequences set forth in Table 4 was expressed in *E. coli* as described in Example 2. 400 mL of LB was inoculated and grown to an OD600 of 0.6. The culture was induced with 0.25 mM IPTG overnight at 16° C. The cells were spun down and the cell pellet was re-suspend in 5 mL of buffer. The resuspension was sonicated for 2 min on ice.

Second instar SGSB were obtained from a commercial insectary (Benzon Research Inc., Carlisle, PA). A 50% v/v ratio of sonicated lysate sample to 20% sucrose was employed in the bioassay. Stretched parafilm was used as a feeding membrane to expose the SGSB to the diet/sample mixture. The plates were incubated at 25° C.: 21° C., 16:8 day:night cycle at 65% RH for 5 days.

Mortality was scored for each sample. The results are set forth in Table 4. A dashed line indicates no mortality was detected. The proteins listed in table 4 showed 25% mortality or 50% mortality (as indicated) against southern green stinkbug (1 stinkbug out of 4 died). The negative controls (empty vector expressed binding domain and buffer only) both showed no mortality (0 stinkbugs out of 4).

TABLE 4

| Summary of Pesticidal Activity against Hemipteran | | |
|---|---|---|
| APG | Seq ID | Tested against SGSB |
| APG00078 | 2 | 25% |

Example 5. Transformation of Soybean

DNA constructs comprising each of SEQ ID NOs: 1-224 or active variants or fragments thereof operably linked to a promoter active in a plant are cloned into transformation vectors and introduced into *Agrobacterium* as described in PCT Application PCT/US2015/066702, filed Dec. 18, 2015, herein incorporated by reference in its entirety.

Four days prior to inoculation, several loops of *Agrobacterium* are streaked to a fresh plate of YEP* medium supplemented with the appropriate antibiotics** (spectinomycin, chloramphenicol and kanamycin). Bacteria are grown for two days in the dark at 28° C. After two days, several loops of bacteria are transferred to 3 ml of YEP liquid medium with antibiotics in a 125 ml Erlenmeyer flask. Flasks are placed on a rotary shaker at 250 RPM at 28° C. overnight. One day before inoculation, 2-3 ml of the overnight culture were transferred to 125 ml of YEP with antibiotics in a 500 ml Erlenmeyer flask. Flasks are placed on a rotary shaker at 250 RPM at 28° C. overnight.

Prior to inoculation, the OD of the bacterial culture is checked at OD 620. An OD of 0.8-1.0 indicates that the culture is in log phase. The culture is centrifuged at 4000 RPM for 10 minutes in Oakridge tubes. The supernatant is discarded and the pellet is resuspended in a volume of Soybean Infection Medium (SI) to achieve the desired OD. The cultures are held with periodic mixing until needed for inoculation.

Two or three days prior to inoculation, soybean seeds are surface sterilized using chlorine gas. In a fume hood, a petri dish with seeds is placed in a bell jar with the lid off. 1.75 ml of 12 N HCl is slowly added to 100 ml of bleach in a 250 ml Erlenmeyer flask inside the bell jar. The lid is immediately placed on top of the bell jar. Seeds are allowed to sterilize for 14-16 hours (overnight). The top is removed from the bell jar and the lid of the petri dish is replaced. The petri dish with the surface sterilized is then opened in a laminar flow for around 30 minutes to disperse any remaining chlorine gas.

Seeds are imbibed with either sterile DI water or soybean infection medium (SI) for 1-2 days. Twenty to 30 seeds are covered with liquid in a 100×25 mm petri dish and incubated in the dark at 24° C. After imbibition, non-germinating seeds are discarded.

Cotyledonary explants are processed on a sterile paper plate with sterile filter paper dampened using SI medium employing the methods of U.S. Pat. No. 7,473,822, herein incorporated by reference.

Typically, 16-20 cotyledons are inoculated per treatment. The SI medium used for holding the explants is discarded and replaced with 25 ml of *Agrobacterium* culture (OD 620=0.8-20). After all explants are submerged, the inoculation is carried out for 30 minutes with periodic swirling of the dish. After 30 minutes, the *Agrobacterium* culture is removed.

Co-cultivation plates are prepared by overlaying one piece of sterile paper onto Soybean Co-cultivation Medium (SCC). Without blotting, the inoculated cotyledons are cultured adaxial side down on the filter paper. Around 20 explants can be cultured on each plate. The plates are sealed with Parafilm and cultured at 24° C. and around 120 μmoles m-2s-1 (in a Percival incubator) for 4-5 days.

After co-cultivation, the cotyledons are washed 3 times in 25 ml of Soybean Wash Medium with 200 mg/I of cefotaxime and timentin. The cotyledons are blotted on sterile filter paper and then transferred to Soybean Shoot Induction Medium (SSI). The nodal end of the explant is depressed slightly into the medium with distal end kept above the surface at about 45 deg. No more than 10 explants are cultured on each plate. The plates are wrapped with Micropore tape and cultured in the Percival at 24° C. and around 120 μmoles m-2s-1.

The explants are transferred to fresh SSI medium after 14 days. Emerging shoots from the shoot apex and cotyledonary node are discarded. Shoot induction is continued for another 14 days under the same conditions.

After 4 weeks of shoot induction, the cotyledon is separated from the nodal end and a parallel cut is made underneath the area of shoot induction (shoot pad). The area of the parallel cut is placed on Soybean Shoot Elongation Medium (SSE) and the explants cultured in the Percival at 24° C. and around 120 μmoles m-2s-1. This step is repeated every two weeks for up to 8 weeks as long as shoots continue to elongate.

When shoots reach a length of 2-3 cm, they are transferred to Soybean Rooting Medium (SR) in a Plantcon vessel and incubated under the same conditions for 2 weeks or until roots reach a length of around 3-4 cm. After this, plants are transferred to soil.

Note, all media mentioned for soybean transformation are found in Paz et al. (2010) *Agrobacterium*-mediated transformation of soybean and recovery of transgenic soybean plants; Plant Transformation Facility of Iowa State University, which is herein incorporated by reference in its entirety. (See, agron-www.agron.iastate.edu/ptf/protocol/Soybean.pdf.)

Example 6. Transformation of Maize

Maize ears are best collected 8-12 days after pollination. Embryos are isolated from the ears, and those embryos 0.8-1.5 mm in size are preferred for use in transformation. Embryos are plated scutellum side-up on a suitable incubation media, such as DN62A5S media (3.98 g/L N6 Salts; 1 mL/L (of 1000× Stock) N6 Vitamins; 800 mg/L L-Asparagine; 100 mg/L Myo-inositol; 1.4 g/L L-Proline; 100 mg/L Casamino acids; 50 g/L sucrose: 1 mL/L (of 1 mg/mL Stock) 2,4-D). However, media and salts other than DN62A5S are suitable and are known in the art. Embryos are incubated overnight at 25° C. in the dark. However, it is not necessary per se to incubate the embryos overnight.

The resulting explants are transferred to mesh squares (30-40 per plate), transferred onto osmotic media for about 30-45 minutes, and then transferred to a beaming plate (see, for example, PCT Publication No. WO/0138514 and U.S. Pat. No. 5,240,842). DNA constructs designed to express the GRG proteins of the present invention in plant cells are accelerated into plant tissue using an aerosol beam accelerator, using conditions essentially as described in PCT Publication No. WO/0138514. After beaming, embryos are incubated for about 30 min on osmotic media, and placed onto incubation media overnight at 25° C. in the dark. To avoid unduly damaging beamed explants, they are incubated for at least 24 hours prior to transfer to recovery media. Embryos are then spread onto recovery period media, for about 5 days, 25° C. in the dark, and then transferred to a selection media. Explants are incubated in selection media for up to eight weeks, depending on the nature and characteristics of the particular selection utilized. After the selection period, the resulting callus is transferred to embryo maturation media, until the formation of mature somatic embryos is observed. The resulting mature somatic embryos are then placed under low light, and the process of regeneration is initiated by methods known in the art. The resulting shoots are allowed to root on rooting media, and the resulting plants are transferred to nursery pots and propagated as transgenic plants.

Example 7. Pesticidal Activity Against Nematodes *Heterodera glycine*'s (Soybean Cyst Nematode) In Vitro Assay Soybean Cyst Nematodes are dispensed into a 96 well assay plate with a total volume of 100 uls and 100 J2 per well. The protein of interest as set forth in any one of SEQ ID NOs: 1-224 is dispensed into the wells and held at room temperature for assessment. Finally, the 96 well plate containing the SCN J2 is analyzed for motility. Data is reported as % inhibition as compared to the controls. Hits are defined as greater or equal to 70% inhibition.

*Heterodera glycine*'s (Soybean Cyst Nematode) On-Plant Assay

Soybean plants expressing one or more of SEQ ID NOs: 1-224 are generated as described elsewhere herein. A 3-week-old soybean cutting is inoculated with 5000 SCN eggs per plant. This infection is held for 70 days and then harvested for counting of SCN cyst that has developed on the plant. Data is reported as % inhibition as compared to the controls. Hits are defined as greater or equal to 90% inhibition.

*Meloidogyne incognita* (Root-Knot Nematode) In Vitro Assay

Root-Knot Nematodes are dispensed into a 96 well assay plate with a total volume of 100 uls and 100 J2 per well. The protein of interest comprising any one of SEQ ID NOs: 1-398 is dispensed into the wells and held at room temperature for assessment. Finally, the 96 well plate containing the RKN J2 is analyzed for motility. Data is reported as % inhibition as compared to the controls. Hits are defined as greater or equal to 70% inhibition.

*Meloidogyne incognita* (Root-Knot Nematode) On-Plant Assay

Soybean plants expressing one or more of SEQ ID NOs: 1-224 are generated as described elsewhere herein. A 3-week-old soybean is inoculated with 5000 RKN eggs per plant. This infection is held for 70 days and then harvested for counting of RKN eggs that have developed in the plant. Data is reported as % inhibition as compared to the controls. Hits are defined as greater or equal to 90% inhibition.

Example 8. Additional Assays for Pesticidal Activity

The various polypeptides set forth in SEQ ID NOs: 1-224 can be tested to act as a pesticide upon a pest in a number of ways. One such method is to perform a feeding assay. In such a feeding assay, one exposes the pest to a sample containing either compounds to be tested or control samples. Often this is performed by placing the material to be tested, or a suitable dilution of such material, onto a material that the pest will ingest, such as an artificial diet. The material to be tested may be composed of a liquid, solid, or slurry. The material to be tested may be placed upon the surface and then allowed to dry. Alternatively, the material to be tested may be mixed with a molten artificial diet, and then dispensed into the assay chamber. The assay chamber may be, for example, a cup, a dish, or a well of a microtiter plate.

Assays for sucking pests (for example aphids) may involve separating the test material from the insect by a partition, ideally a portion that can be pierced by the sucking mouth parts of the sucking insect, to allow ingestion of the test material. Often the test material is mixed with a feeding stimulant, such as sucrose, to promote ingestion of the test compound.

Other types of assays can include microinjection of the test material into the mouth, or gut of the pest, as well as development of transgenic plants, followed by test of the ability of the pest to feed upon the transgenic plant. Plant testing may involve isolation of the plant parts normally consumed, for example, small cages attached to a leaf, or isolation of entire plants in cages containing insects.

Other methods and approaches to assay pests are known in the art, and can be found, for example in Robertson and Preisler, eds. (1992) Pesticide bioassays with arthropods, CRC, Boca Raton, Fla. Alternatively, assays are commonly described in the journals Arthropod Management Tests and Journal of Economic Entomology or by discussion with members of the Entomological Society of America (ESA). Any one of SEQ ID NOS: 1-224 can be expressed and employed in an assay as set forth in Examples 3 and 4, herein.

All publications and patent applications mentioned in the specification are indicative of the level of skill of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

SEQUENCE LISTING (224 sequences)

SEQ ID NO: 1 - protein, 724 aa, Bacillus sp.
LSIIRIRKMNKKISRGRLCNMELKVNDIEIASNDKGYSHDSSIGYSNPNWMNKMPGTLKISELSIPGTHNSMSRYGGGGLYPDDYIKTQTMDVNTQLNSGIRYLDIRLRKESNALLKAYHGSVNQNAIFSSDILDKITAFLRTNPGETIFMRVKNECNGPGTGKCTDASTTKTWAQIFEDNYYNNASYSNYFWKGASNNPTLNEVKGKIVVMSDFPTDGKRFGIPYNTLNKQDQFDVDDSADAMYAKWTAVGNHLKAANASDKQSIYLNYLSGNGAWRFISMGAAPYFVASGYRGSGTNESMKMITEHRTDKWPDYPRGYYGQVFYGGTNLLTTQYIQQWPIRHTGIIAADFPGKGLIDRVIRLNERHNSGDVRYITPKGSSGLRVGFGGDAYLRNSYVVYRNGTYIGHVDSGSPYYSYWDKTDVGHDLRFEGLALFTGDKIDVYVKNGGSSTLIKSQTLTVDEQEGEEVRIPDGKYSIVSALNNSSEVAMQTSLSNNRYNVVLWGHTNRELNGQWDLVYDSNKKAYQLKSAWKVDEALTWTQDSINVYTSPSMGTYDGAYWILKRAGNGYLYLENKASKTVLDVTGGGTANGTNINVWGQVQGAQNQKFKLIQRTEKLEAHIDSLYRPQPGQKNRSSGNFSLGHLADGTRVQVSIEGPGASVLNFRVMRDKSGDTDPTIWSNVKHGSIVTIPSGANKNNLYIANPGGYSGNGTFKAKFQTLQN

SEQ ID NO: 2 - protein, 704 aa, Artificial Sequence
  Synthetic variant of native sequence
MELKVNDIEIASNDKGYSHDSSIGYSNPNWMNKMPGTLKISELSIPGTHNSMSRYGGGGLYPDDYIKTQTMDVNTQLNSGIRYLDIRLRKESNALLKAYHGSVNQNAIFSSDILDKITAFLRTNPGETIFMRVKNECNGPGTGKCTDASTTKTWAQIFEDNYYNNASYSNYFWKGASNNPTLNEVKGKIVVMSDFPTDGKRFGIPYNTLNKQDQFDVDDSADAMYAKWTAVGNHLKAANASDKQSIYLNYLSGNGAWRFISMGAAPYFVASGYRGSGTNESMKMITEHRTDKWPDYPRGYYGQVFYGGTNLLTTQYIQQWPIRHTGIIAADFPGKGLIDRVIRLNERHNSGDVRYITPKGSSGLRVGFGGDAYLRNSYVVYRNGTYIGHVDSGSPYYSYWDKTDVGHDLRFEGLALFTGDKIDVYVKNGGSSTLIKSQTLTVDEQEGEEVRIPDGKYSIVSALNNSSEVAMQTSLSNNRYNVVLWGHTNRELNGQWDLVYDSNKKAYQLKSAWKVDEALTWTQDSINVYTSPSMGTYDGAYWILKRAGNGYLYLENKASKTVLDVTGGGTANGTNINVWGQVQGAQNQKFKLIQRTEKLEAHIDSLYRPQPGQKNRSSGNFSLGHLADGTRVQVSIEGPGASVLNFRVMRDKSGDTDPTIWSNVKHGSIVTIPSGANKNNLYIANPGGYSGNGTFKAKFQTLQN

SEQ ID NO: 3 - protein, 401 aa, Bacillus sp.
MRSISKKVMAGLLVGATSLSIWAPISEAAAPENNRYYNIQLKSNPKKVWNVSQASNDNDRAILLWQGGSADHEKFAFFQLDGGAYAIVNKNSGKVVTFGTGSWISGGPIPASETLQQQSWTGEAKQKWNLRDLGSNGDRSNNYEIVNQANGKVPSYRWIGSTVDNTEFLQLDNSNPSDADKVFTLFNGTGNLFGIDITFFNDTISVPKLPAIGTRPDVPDYTGGVNQQLPQTSNSVVVGASLIPYFMVKDNQANDYTKIHNSPYYTLVKEEYWDKTFSKVIQPGLSEAYSYKTGVSSVDQQKMTDTLSMNFGADLGIKFGDASASLKSEISRTIQTEISTTNSEATEETRSYTATGEPGKATGYTQYQLATKYTLKRADGSIVSDPWVVKNDKITVTRKTS

SEQ ID NO: 4 - protein, 1235 aa, Bacillus sp.
MKQQYNNEYEIIDNDVMGYQPRFPLAQAPGAELQQMNYKDWMNNMCAEGESRETFADITVKDGVTVAISIVAAVLGVSFPVSAAGVSIISTLIPYWWPETAGTPGTSQAQVTWERLMSAAEQLSNQRILESKRSDAIARWQGIQSLGRDFYQAICDLREDPDNEYKKTKVRNTFDSVEDKLKTSMPFFRAQKFEIPMLSMYAQAANMHLLLLREVVQNGVSWGFQRYEVDRYYSHTDPFLGNPGLLQLLEEYTDYCVQWYNTGLHQQYENNRYNWDTFNDFRRDMTTMVLDIVSLWPTYDPKRYPLPTKSQLTRTVYTDLLGFSGDIEYLQIDIERAEEELVQRLGLFTWPRELIFQLKSLNQINFVTGSEMTFNYTASANGYRERKGDPGETRETVVIPSPDVGDDIWRISTQVNTTQIPNANFVRGWNFSFTQSLDQKIAWRTTSSPEIVMQGLSCHGPSIGSCDLCSSNNSCRSINPNYSSPCDDKSVYSHRFSYLGAGLKSDLTRLTYFSYGWTHVSADKNNLLDTHMITQIPAVKGYNLYQGARVIKGPGSTGGDLVELGVNGGVFVKVVTPASETVSGYTIRLRYACKTEILLFFRIRQPDSDDRVTIVNLPATTSDDNLTYIAFNYYNSWLGLENVRATQEESIIFLQNFSNENTIIIDKIEFIPIEGSLEVYQSNQDLEKARKAVNALFTNDTKNALQLDVTDYAVDQAANLVACVSDEFHGQEKMILLDQVKFAKRLSQTRNLLNHGDFESPDWSKENGWRTSHHVSVRSDNPIFKGRYLHMPGATSPQFSNNIYLTYVYQKVDESKLRSYTRYLVRGFVGNSKDLELLVERYGKDVHVEMDVPSDIQYTLPMNEWGGFDRCKPASYQARSPHTCTCQDTAVAHTDCQCKDTVNRTSTNMYTNVPTGSAGYRNESHDHKTCGCKDPHVFTYHIDTGYVDQEENVGLFFALKIASENGVANIDNLEIIEAQPLTGEALARVKNREQKWKQEMAKKRLETERAVQAAQGAIQPLFTNGQYNRLQFETLFPQIVHAERLVQQIPYVHHPFLNGALLAVPDMNFEIVQHLLTVIGNARALYEGRNLVRNGTFSSGTESWHVSEGVKVKPLQNTSVLVLSEWNHEASQQLRIDPDRGYVLRVTARKEGAGKGTVTMSDCADYTEILTFTSCDYNTIGTQTMTGGTLSGFVTKTLEIFPDTDRIRIDIGETEGTFKIESVELICMEQMDDHL

SEQ ID NO: 5 - protein, 673 aa, Artificial Sequence
  Synthetic variant of native sequence
MKQQYNNEYEIIDNDVMGYQPRFPLAQAPGAELQQMNYKDWMNNMCAEGESRETFADITVKDGVTVAISIVAAVLGVSFPVSAAGVSIISTLIPYWWPETAGTPGTSQAQVTWERLMSAAEQLSNQRILESKRSDAIARWQGIQSLGRDFYQAICDLREDPDNEYKKTKVRNTFDSVEDKLKTSMPFFRAQKFEIPMLSMYAQAANMHLLLLREVVQNGVSWGFQRYEVDRYYSHTDPFLGNPGLLQLLEEYTDYCVQWYNTGLHQQYENNRYNWDTFNDFRRDMTTMVLDIVSLWPTYDPKRYPLPTKSQLTRTVYTDLLGFSGDIEYLQIDIERAEEELVQRLGLFTWPRELIFQLKSLNQINFVTGSEMTFNYTASANGYRERKGDPGETRETVVIPSPDVGDDIWRISTQVNTTQIPNANFVRGWNFSFTQSLDQKIAWRTTSSPEIVMQGLSCHGPSIGSCDLCSSNNSCRSINPNYSSPCDDKSVYSHRFSYLGAGLKSDLTRLTYFSYGWTHVSADKNNLLDTHMITQIPAVKGYNLYQGARVIKGPGSTGGDLVELGVNGGVFVKVVTPASETVSGYTIRLRYACKTEILLFFRIRQPDSDDRVTIVNLPATTSDDNLTYIAFNYYNSWLGLENVRATQEESIIFLQNFSNENTIIIDKIEFIPI

SEQ ID NO: 6 - protein, 404 aa, Bacillus sp.
MRKYKKLAVVVPLAGMLMSGAGVLGGATSAHADRINIDGVRTGGPVSDGGNFSDTSGGQTFSDKELANIYLQHWKEGKYGNWRDGLYMSHGDFSDFPPEFKAGVMSPGYLIPQAQLPAIIEKIKNTEQLELMDLLQILTPETTVDKDVQKHRYLTVNTDKKTRINIDKTEVISAPIAAPQKVTNDTDQEGSATAPSISKKFTSTISRTDTHSTTLGMKQTIKGGIDFLGIAEGDFSQEFNESYTYSNASQKLTSDETTITSGTVTIKTQPHSAYKFDIIFQQVKNSGTVTGTSHLGGGYGSSGKDAYYDLSIYKKMKVIQDLYPQLWAVLQAKGIDVNDTTQEVNYTGAISFEGITGAKIDVTVKNLATGDVINRLITPTPVKPGTNMNITEQLQGTIQSIVSQ

SEQ ID NO: 7 - protein, 353 aa, Bacillus sp.
MVKRDISARDLGGKEDTPFLLKKDEWIKIQKYTGDGAYLPVNVNEMRKALLLPNTEELPDFGELYTVNTSIKGHCKNWNDTTYREILDVANKIVNYSRRAEVFYAPLLECLPDILEGDTVALEKFQKICKKLATEAKDFSDHAETLAKNVEQFANDTANDYKNLINVKVKYDALYGKNSEEVTRLRAEVEKLREELEGYIEDLEDFEEEVWLSLLLGPIFGFVLKEILESTKGKMLQAKIDATRQKIEATNATIQRNVYLMSLLDKADVGTDKTQNQIEEALPVINKIKAIWYSLHTDLLTLSNITMKDIHDDPEFADLGIELAIMQWVKVGKQADDFRINADVGFIVDQYIA

SEQ ID NO: 8 - protein, 494 aa, Bacillus sp.
MDTKFLVTFLKELINEKSVNKVMASTGTQFIKNAQKNPDNFNNTFRTLAMVSAEFIPVGGIFISPLIGLLWKEEGTSDQINALRNELSELIDQKIETEHLHSLAKEFEILEGTIKQLESSVNGHSEEYFESHGTIQESRRNWAHSIQRSFQRLIGLASQDRHKIADLALYTKIALSHVSFLNCIHENGQGSKFKYDKQSLLDFFNHSKLSDIIDNYTKYIEKTFKEGDDKFKEKIKHREALKQDLIELRKQPSTGFGDLLKEKKMRDLEEQIKNYEKMDLENCQNKFYYTTWGDETLQALIKGRWTLKDGKLYFVNKNGEKQTRWLQLGVKWYYLSPLENNTNTKGETFNIGQMMIGWVRAEDKWYYLSPSDNNMEIFNTGQMMTRWAQDGDKWYYLAPVNDAKNYDGIKFAQGQMMTGWVQITDRNDKKDYYYFSPSESTVNYDGIKFAQGQMMVGWVKVSGKWYYLDKKDGYMLHDTITPDGYRVDEQGVLK

SEQ ID NO: 9 - protein, 1146 aa, Bacillus sp.
LFMITSEYEGDNKMNPNEEYKTTVPHSNKIQPRYPLTNNPDHPLQHTNYKDWLQMCQNTSFDGENPVPSVTEVGAIGIAISIVSTLLSTFGAAVPGAALAVLGATLPFFDSGSGSVWEDFMIHNSSVLQKTLPESIKNQANTILTGLQESLIEYKRVFNIWKKDKTPAHAEQVRSTYRNTHNLFINRMSELRPSQYKQILLSVYCHAANLHLGLLVQGVAYYNEWYNVNPSLLTPDRTVDDEYLLLQDKIKEYIDYCSKTYREGLNILANSQANLKIYTTYQREMTFTVLDIITNFPYYDFKKYPIGVQSELTREIYTIEQQIKQIYLNHLTRQPNLVTHPFNSSIYHYRNLPFITSGFTAVRNRFWFTNARNLSVSGLYGSTSFDGQFDVSTQNVWKVEATYADVARRLKQLKFYAQLPNPITATTGTPNNSDYRELFTHEIPGRDGKLPTTFQTASHYLSYMMMTASESPGLSCAWRHASVNNDNLISPNKITLIPAVKARELDTSSKVVSGPGHTGGDLVEFNMAHGRLELQGSIGNVSQERFTIRLRYAAAANESPRHLLVTIPNIGVFPVMLLPTTYKLSLNEFSYNEFGFVDIIPSNESISFFASIPWIVSITSTRGSIDDKVYIDRLEFIPISRLPNRQRQQLEKTQQVVDGLFTSSEKQEIKMSTTDFRIDQTSTLVECLSDTEYPQEQLLLLDQVKYAKQLSQSRNLLSNTFGNQGWSTQGDVVLSSGGSLFKDSYFSLPGARTTQVGPDTFPTYMYQKIDESQLKPYTRYKVRGFIEASNHLEVAISRYGNEVKTMLHVPDDLATSSTRDNCGEWNRCETTQHFFTENTEEISKPAVSSTTCSPCDATHTSHKTCIDSHDFSFTIHTGDIDITNKPGIHILFKISDPDGFATLGNLEVIEDGPIFEDTISTVKYQEQRWKQNLIEQQQKTEQAFLQVQQAVDSLFQDSQYQTLQLEVTASQIHSAENLLQEISSMHNDIQSPKNEERFTALNNQIQQAYHLYSKRNMVRNGDFSEGLHYWSASSDASIQQTQDDSVLLIPSWSTQVSQQLRLQPNHRYLLRVAALKEHIGKGWIKISDCKHQVQTIHFSSCDENEIHHSIYQTKSIPFTPTTDQIRIDIGETEGSFTIRSIELICL

SEQ ID NO: 10 - protein, 639 aa, Artificial Sequence
  Synthetic variant of native sequence
LFMITSEYEGDNKMNPNEEYKTTVPHSNKIQPRYPLTNNPDHPLQHTNYKDWLQMCQNTSFDGENPVPSVTEVGAIGIAISIVSTLLSTFGAAVPGAALAVLGATLPFFDSGSGSVWEDFMIHNSSVLQKTLPESIKNQANTILTGLQESLIEYKRVFNIWKKDKTPAHAEQVRSTYRNTHNLFINRMSELRPSQYKQILLSVYCHAANLHLGLLVQGVAYYNEWYNVNPSLLTPDRTVDDEYLLLQDKIKEYIDYCSKTYREGLNILANSQANLKIYTTYQREMTFTVLDIITNFPYYDFKKYPIGVQSELTREIYTIEQQIKQIYLNHLTRQPNLVTHPFNSSIYHYRNLPFITSGFTAVRNRFWFTNARNLSVSGLYGSTSFDGQFDVSTQNVWKVEATYADVARRLKQLKFYAQLPNPITATTGTPNNSDYRELFTHEIPGRDGKLPTTFQTASHYLSYMMMTASESPGLSCAWRHASVNNDNLISPNKITLIPAVKARELDTSSKVVSGPGHTGGDLVEFNMAHGRLELQGSIGNVSQERFTIRLRYAAAANESPRHLLVTIPNIGVFPVMLLPTTYKLSLNEFSYNEFGFVDIIPSNESISFFASIPWIVSITSTRGSIDDKVYIDRLEFIPI

SEQ ID NO: 11 - protein, 178 aa, Bacillus sp.
VERTMEHKKIDAPSISYASLSGHPVYDKNHILSFSNIINIPKGFQITTQNKLNFSYHVSLLSMVQENCKRIVEIEDCGQLEVDLQILKIKGSIPYIVNLYLEPIPPTNHCVHILLEDPIALSYQDTLYVDQVLLCSTRKLPYYVIDTEHIQIKNLQVETVEPQQLVAKVKGEFHLDYQ

SEQ ID NO: 12 - protein, 346 aa, Bacillus sp.
MKKYKNRSFTMNNKKNMKRKIAATSSIITLATSFAFTSPELVKADSKNSVSKNQQYMAAEERPTVPVSTDEDYGIRSLAIDNKDTFYDVVRKIVGWNGIQDLSANFLHYAKPTYSVDLVAEPKDEPLSPVLIGKTNIQNKSQSTQKLQSASMSKTVTSTVTSTVTHGAKAGAKASAKLKVPLVAEAGVELNTEYNFASAGSNTSTETLTYTLPSQSIELEPGQRATVTSDLSMMKTSGEVQLRTKYEGYVHLKGTLINTPNNIDNNIKMGDFVDRFIKADSSLREYWHVNSPNDFIAYQVGKGNFTAEYGTVANITVEIFNQDGTDTTQPIKSYTYTVIPEVSKNI

SEQ ID NO: 13 - protein, 258 aa, Streptomyces sp.
VTLISALARPPADPVGDGGNGDDRTPGHRRGSPGTVVSGPSSSARRSLRHTDPSLINRLFKEDSLAASFKTVIEVGPAHLDQAQALGRAFQDAIAPATVNYDFDHIRDAAAAIPDSSIVKMVRGWGLQEHAPVLVMVLSLKEAVRQALPPESAEASFWDTVERELVDAFTGLAAQEGLPGLSYYEEGADRTRYYRDLFFALQDEETGGHMYAIAFCIDVTIGLDKARVGALEMTDAVPFALRLNAIVLRQELTRALTA

SEQ ID NO: 14 - protein, 304 aa, Bacillus sp.
MTDTKMTIEYLFTPYYGVNPNGSNINPYLLNANHWNSVMCYFNYISPYTEIRNRDTLGKLLYSSVNQQQAFYRFFDVYNLQDVFQPIFDLHRTISNASTWWTIQGHQQITLLVQDIRSFTNILCVRHIDKLNQIIKDVQKERVSTKTKDQFTDICIELQARTSGYYQRLDILDQSKKFVNILLKYNPAIHTTLNHLEKIYSDSEFKAVDKHYFKKLLSFVRKQQIFVQYYTYTIGTLQALTNLRGIWTEYGLNLQKLIEACDNNLVYFNSLLARLKLENAINAWQDVKKKADRFLQTWQDDTRC

SEQ ID NO: 15 - protein, 391 aa, Bacillus sp.
MKSVSKKVMTGLFAGAMGLSIFAPASQAATPEQNEYYNIKLKANTYKIWDVDNASSDNDRVIRLWGGSTTEANRQFVFFPLDGGAYAIVNKNSGKPVTFGNGAWFSINGGSSILAGADILQQQSWTGSANQQWYLRDQGNNNYEIVNQGNGKVASYAWGGTLAQNWEYVDLDESKPYDSNNVFNIANSGSSISLPNLPAKGDRPNAPDYNQTGRIDQQLPQTSESVVIGASLIPSIMVKDNSASDYTKIHNSPYYVLEKEEYWEKVRSEIVPAGGSSKYTVKRGVSTVDQQKMTDTLNMKFGTDLGFKFGDTTASIKSEISKTLQTEVSKTSTDATEETKEKGFSSTSGKDTGLTVYQLVTKYTLKRTDGSTVSSSYVRDGDQTLERTIAK

SEQ ID NO: 16 - protein, 325 aa, Lactococcus sp.
MKKNKKYVMVISCRLLILSFGMVPKNVLALNQGGAGNSGSGYLVNNMSEKHEDIIDPEDIFSNMLNAVGKYKEHKDPFLFVTRNSIGSLSSYSNFNAEQDGDPIIENESLLFVGESILTNNMNTEQTLKTNSFSKTMSNTVSSQVTHGFMLGTEARTSFGIPLIGETELSLKAEYNFSSSETNEISESYTYGVEPQEILVPPHSSVKVRVDLNTADISGKVKLMATPKTDFGDIDGYFHYGPDEQNIAESIPFTYNWNTLTKEVRQLNLPVDDIDYDFNNQTPKLVGSGKYKAKYGTTFKVEVIPINNPKAEGYSYSIQPTHTAN

SEQ ID NO: 17 - protein, 546 aa, Bacillus sp.
MKEKKNIQERIGDNVKYNERKKAKRNYKKAVLTAATAFSIGVTSIGGATSAFAAEKPPAQQQPQSSVKSVGGADDVYSNEINNPPFKIEGDALTLTKNFLSGDLAATAKKMWGSSLNLAVQSAQGKNVLNVNNLARDMVMVGTSAIPYGGVILSSIIGVLWPMSGTNQMQALMDKMGQIMDQKIEKYDNTTLTSKINAVEVALKRFETILYGTDDVYSDTNKAGEALRQATVIQNAFTELINESKKEEYETSELPAYTMAATAHLLFLSFMVTNGTSILGLEPDTMKNSYNNDLKNALSEYNSHIQRIGSDSDYKLSQLPQKIDAARVEIEKAKAGMNPPIGAAAGYWAEIYQQKSQELHNLLEQQKQLTDLVNSTTKNEAFAAALKSAKTTADNKGIKYEEKDSSKIVDGGTYKIISALNNGQYVDNQRETKNVSIYHNTRSDNQNWKFIFDSSKQAYKIQSVYDSRVLATSSSANYNVFTYNFDGSEDQFWIPEDIGNGTYIFKNKKYPDRVLDIFEGKAEDSTNITAYPRNNGAGQKFKVIQQ

SEQ ID NO: 18 - protein, 432 aa, Bacillus sp.
LVLSFYIAKVILFRNKSISNVQYNFIFCNLVGILPTKLGGNIMKSISKKVMAGLGVGAMSLSIWAPSSQAAAPANNEYHTIHLAANTNIAWDVYKGWQTDDAGIVLWDGVRGDNEQFVFFPLDGGAYAIVNKNSGKPVGIGSAIIGSDGVRNFPSYNNQGLRQTSWTGAPNEQWYLRDKGNNNFEIVNQGSGKVASWAGVEMYGFKDYVDLDESNPSDKDRLFNIPAARSTFSLPTLPTVGTRPNAPDYNTSGAIDQQLPQTSNSVVVGASLIPSIMVKDNGASDYTKIHNSPYYVLVKEEYWEKVRSEIIPAGATSKYTVKSGVSEIDQKKMSDTLAMSFGSDLGLKFGESSLSIKSSVSRTIQTEVTKTSTNATEETEEKSIPSIPGKNTGFTAYQLVTKYTLKRTDGSVVTDPSIVRDSKQTIARTIAK

SEQ ID NO: 19 - protein, 420 aa, Bacillus sp.
VILFRNTSISNVQCTIIFCNLVGILPTKLGGNIMKSISKKIMAGLGVGAMSLSIWAPSSEAAAPAKNEYHTIHLAANTNLAWDVDNGSVDNDRAILLWNGDRNDNEQFLFFPLDGGSYAIVNKNSGKPVTFGGPTWSGSGGILGNQNLNQRSWTGSSNEQWYLRDRGNNNYEIVNQGNGKVASYAYQWASRHIEHVDLDESNPSDNDRLFHIPAAARSTFSLPTLPAVGTRPVAPEYTQGGSIDQQLPQTSNSVVVGASLVPCIMVKDSQASDYKKIHNSPYYTLVKEEYWDKTFSAVIPAGLTRNYTFKTGMTSVDQQKMTDTLSMKIGADFGLKFGDASASIKSEISKTIQTEISTTNTEATEETITSTVTSELGKTTGFTEYQLATKYTLKRADGSVVSDPWVVKNNKITVARKNSI

SEQ ID NO: 20 - protein, 301 aa, Bacillus sp.
LRGKFMKKLMFSLVATTISMGLILGSAPAKADVSNKNSAYQDIGERVKKMAQSAAWGGQEYRSHNIKDIELKGNLIDGSMVENSQVLTVSSDVLENNLGHTVNMPSTGYEHEFEETTSTTNTSGWKFGYNYNASFSVLMVSASQSFSVEYDMSTSDTHETKEKRKFTVPSIEVPVPAGKKYKVEYVFEKVKVSGKNKIDASLFGDVTYYYNNQPMSPQLLYSVQGLATDKQGFEQVIRDSAIGNDRFGIKTTGIGQFSTEFGTRLTRTLTDITDARNPVKLETKNIPVEFKTLSIDTRVIK

SEQ ID NO: 21 - protein, 585 aa, Bacillus sp.
MKPKSEETQPPSPKWSKSEYNNYRNGYAYNANIGYENKNWMNALRGETKISQLSIPGTHGSTALHGIPGADRWIINQRMSITTQLNSGIRYLDIRARRTGTSFAMHHGQAYQKKMFGDILNEVTAFLRQHPGETVLMRLKEEHTPEDGSRSFEEILKGYWDNPSYKNYFWQPAGSGNGSGVNANPELKDVRGKIVLLQQFAVSKAYGINYWNLEKQDHDNVRFSMDGMYAKWTAVKNHLIKANSDQNKIYLNHLSGNGGPSGGAAPEFVASAYGGDGEPLMGTGSPSQYPDFPTENYRLYFGGMNIMTNQYIPRSGLQYTGIVAADFPGKGLVERVIKLNDKHIDVSAIHHMGLNAQKKVEIGFTGNYLSNNYVITKNGEYIAHYDKGTAYYAYLSKTDYGHLLTHDDGYSFFNGDKIAVSLEHSNGARTLLKEFTVNIDENNLEEVKIPDGKYNIVSALNTSKVADMTGNNNVVLYTKHGDKNQQWKFVYDANKQSYQIRSEWNTNVALSYVSGSGNVLGESINTTKEEQYWKLRRAGNGYLYVENKKNGWVLDVERSSTSDGTNIILFVRTGTTNQKFKLARS

SEQ ID NO: 22 - protein, 348 aa, Bacillus sp.
MKTKIKLPNKKLMAKSSIIALATSFALISPDLVNADVINLKKGFEQQKQIAADVDPIPVPIENVKGLQDLWLDSKEMKCPLADLIGTAPHNLSNLHFNFLYYKEPSYSVDVIKKNEEKPSSPVYMGTTNLSHSGGTSEQTLYSQAFSKTVTSSVTTTITHGAKVGAKAGAKLQVPLVGETSVELNAEYNFAKAGSETGTENVTYTVPSQPVKLQPGESAKITANLRMAKASGEVRLRTTYTGEIQSNFFVNTPYGPMEDSDTTGLGEWMKTLVDFNEDLKNQWTFSPTYASVAYQDGKGTYNATYGAVLDIHVDIFGGSNKGRKKRDADSTPIRSYSYEVTPEIVENN

SEQ ID NO: 23 - protein, 291 aa, Bacillus sp.
MAIADLDAYLIALGKKIGFPSITGVNTSNLRVENAESYGFEIKDSKPQGTMFMGESELKNDTDQTQTIKSDSFTKTITDSVTLSVTNGVTTGVSVTISGKIFGIGAESSMSFEVSTSTTNEQTSEESVAYTVPSQNVLVPSRKTYYVYTSLQRSQLEGTIRLKADLSNHFSFKTSGNVSPALMNIYDFVNHYQSLHPLPSGISLNHKDKSIHFEGVAEYIYGTGTKFYVTISDKPSSQGTQEHKAFDVKTGLGTYAIRLDGKRFDLTLNDLKDHLEPKDFEKIMELQNEIV

SEQ ID NO: 24 - protein, 288 aa, Bacillus sp.
MSIYNVEADLFDLCREYAIKHYDANDATFHGATIYDRSVLNSEVMPDQVEFNVIPDLSNTVINTITNATSIEQSMSTKLSTKTIETTSFTTTEGYKVGTSIKNTLEFKAGGLFSIGGVEHKFEVSVSGEYNHSSSETTTNTTEKLWEYTAPIKVPPKTKVEGKIQIYSGAIPVPVTLKSTVLGLGQSPNGKLQNALTSLWYKDKAGKEWVDTYQTSHLYTLREEWSGYKPIYVGSDGNGVKLQGKGTVGLDLGLYAVVTFKEEPLPGNYSMGNERTYSKVIFRDGRVI

SEQ ID NO: 25 - protein, 332 aa, Bacillus sp.
MKRKNNRNKSLLIVATISTIGLTGISSTPAFAAETPAINSKAKESYYSGTIDLMFINEFNKNCLSIDNNNSRTIIKDLKPAREQTESIDSFEVDNSNSNSTRIFKSQQKTYKNTDTVTVTHAKEFSFGQEISAELGAPKLLENLLNMAKINLKATFGQKITNSKAEAKSQEQSTTYGGDNIEVKPGQKVKVEYEYITNIYSGTLETLAPLKYNVKDPSMSYVSPKDIPYYKKTLPYVAKLSGGKKYSTDYEFFKDVHNTPDDWAVLIAYDKGDAYFFYAWELKDTTTLNDNKKQVYSKGSAKFEAVRGTGVKVKVTDLDTGKIVKDKVVSYF

SEQ ID NO: 26 - protein, 595 aa, Bacillus sp.
MKYKDRKDAKRKYKQALLATVATMTLGVSTLGSTASAFAEEKDKNIAQQGAEQGEPAEKDTTATQQQNTVQQKNPGTYYEDEKLNPIAQLDKWTQDLGKNTGAANYKTSLSAVEKIMPLLIKDITKDNYNNSLRAVTMFGAALIPYGGSFISPLIGLIWPESKDDAALKLKKQLDDLRKELSDLMDEKIDRFDQEGIQAAANVINENLKKLEDGIAGKTPGIFYDNQKKLEDGIAGKSEGSFYDSQSGFTVVYSINSAFELLLANASKPSFKMQELPLYTGLAAAHLQFLEFVKQNGKNPKIALTNENYNTFVNKIAEKTPVYTQHIEDTYNQFRSKIEQKMTPLLQGVIGVTSDEQQNLGAAFDKTIELQRKVVQITGGDRLGINSKDKQKLQTFIDNKENYKKLMETKSDYYNSTVGLFAVTQGIPSKIQKPETTPTWGPLKTLQGPVANGTYKIASKLDSNMLLDNDHNRNRLATLNKDITTKDNLWGLGWELRYNPDKQAYKFISKLGSDELATNGQDDTVFATTDRNDNDLRYWTLEPAAEDGYFFIKNKASGRVLDVTGGNTAAGTDIKTNVQNTPAVAAQLFKLETVQ

SEQ ID NO: 27 - protein, 303 aa, Lysinibacillus sp.
MREYFMKKLTLATLATFMIVGLIFGAVPAEVKASEHGKNNVYQDLDERVKRMLISAAAPGTEYRYHNIIHAELNGGDVEGTLIENSETLTVSRNTLENNFDHEIELPTSGYEHEFTETTSTTNSTGWTFGYNYNVEISIPMVSGGHSFSVDYNMSTANTVEKSETRRFSVPSVLIPVPAGRKYLVEYRFEKQTVSGRNRINADLFGDAVYYFNNQPMSPQLLYSALRFATDTQGFEQVIRDSAVGNDRFGIRGTGVGQFRTEFGTSLYIRTTDITNSQEPVIIETITIPVKIETISEKTKVVE

SEQ ID NO: 28 - protein, 341 aa, Bacillus sp.
MRYKYKIKHHNKKKGAINMKKNKKKQILSLAILTSIGASMTLASPGSASADQISPIQKITQEQQNVAISDWREPFQKTYKSAKLRDPNRYFSNEAKIDLWGVYQSSVEADGSPTITNSKSLFVGRTILTNHTNQAQTLTTNEFSKSFGNSVTNSTTNGFNLGVSTSASFGIPLIGETGIEISTEYNFSNTAEKTKTESYMYTASPQNILVPANSSVEVIVNLNTAKLNGNVKLLSHVNGQLMWNTSKTGQKISTSFKGFLEKAARPNEIASNVKAHPRNGAYLIGKGKYSAEYGTEFSVTVRPVQKPSTVAAKSKSMVSEHSKTTSESYTYTVKPEVKKEQ

SEQ ID NO: 29 - protein, 380 aa, Bacillus sp.
MLQNKNKLFFTGISALTIMTSGLTISTPTASANTQESTPSVYPIQGTEFSDENGQVISPGAFATLSPYWLINDSNDQLLNFYNQVKQRLLDKQNTEQNMLKLDEYLNDLWFVGAVSELYATPTDYNKRLEASQLVRWYKNNNAARPTFEILESKLENVEPILDITEPIGYFATESEYTNNSPHQGEYLIPGWSNTTSTTYNTTTTKGFSIGANTGIEIPLPFMDKLGLTGSYNFSKAENVSTTDSTTLTIPVQTIQVSPFSHSKTSFYFQTHQYRAKFDVTSKFKADVGRDAEYTKKRSAFYLLAKYNEYLPKGIVVENGGKLTLEGKGEISVPNHINGFKLVKETKETPLLGGEGKTTKEIYTKDPNTNKLIPDASSKS

SEQ ID NO: 30 - protein, 257 aa, Bacillus sp.
MDLSHLNLSEVSEGIKKLEASDFYMNQYLELYDRPAHLVIISQNVSESIDPNYQSMSYLPANGADDTAFDLLKKFDPAVVTSPAPPGGNSGLMMDMAVAQKIAKSLKYGVIEGVDIKSKQSNSVKIADHITAVYNMISSLVTTVASDSVSGFTSILKAGITNLFTDIGKEVDNGAGGIKKRWAVVTYDKSNELSYTYNQMFAYPNTNGKYIGMMLMSTQTKITSNSLDLLILKPYDIATVNSTTNIIRLVHKIGPVE

SEQ ID NO: 31 - protein, 947 aa, Bacillus sp.
MIMQMVTKAMNPKLGALPDFIDDFNGIFGFMGNITDVMSTIFGVDTGDSSIDDVLNNEELLKQMMEQMDTMQDSLEDILKNQEISKNIQEQILALTTDLATSINKELVKIEGILTTYLNAISGMLKDIYSQTSVIDQKVDKLLAMMTFALKELDYIKDNVVLNSSIVEITPHVQKLVYVNKKFLSLTRGFLQGEVLSIDSMQEIQEWAKSILATEMNSFEFSVDTLHNIIIGDNLYKRSALKTFSDVLLDDADQYGDFGTPLAKFYTFFSSLATLQINAYLCLTFARKVLGLSEIDYQVTMQDRIEQQNQMFVNLIQDKNYSNALETKGIYPMPHNVGDCNSFDLQAKNGYALIGLEFFMDNNIYKIKAYQGKIDKNFSLYADTVEEIISDDLSAVFPAITENAPRLDIVFPLSGELIGPPNTVITRIGLGTKYDKNRESDVRTFAYIDADFSLYDYISGTISKEGTQTVALEGNAQNGCRCYDMWPIGLIGDLYMTPLKGLSLTVDEGTLNMSGESYFSTILSREYNTNFILFPHSSNSGSINENLIRNGDLEEQDKYWEGTEPSFFVEGEGTFGSNALKVQAQGAFDQIVKLEPNTTYRLTAFTKVKDSNYSKGRIGIRDKYAYRVEESFLHTRYNQTKVEFTTGADTSKLSVFIQGGGDQESIAWADNIELYKVHQQDNMISDFNFDTYKYSNMCWELSGGGDLVEQEGLFNSKALKITNSGGAEQEVKLKANTNYIFTAYVKVDNTTAQIGCGSNQVSCNSTSYTPVKLKFRTGVDPSTTEGSIYCSNLNDSGTVWADNFVLCEAPNLIINGDFEQFDLSSWNLSPSEGGSIYLQSGLGMSRSNAIVLRGTGNEAGKISQKVPLKPFTKYRLTAYVKVSKGSIAHIGYGDNTCACAVDDFRQALVDFTTGANPMQSDDAIYLSSGNSKYTVADNFELYELDQI

SEQ ID NO: 32 - protein, 426 aa, Bacillus sp.
MNLPRLEKNGLRKLEKDVISLLEVNLDNHPLYFKNYEVIPEEVKAFYPLYLASADEDTGKYGPGDLSTPDGFIISREDWSYVQSYIQTGMGLPTDADAMREHLTIPASTAMPDDFNRVYNVYSSDKFLCDWWNKTLWPSIFKAASLVTNYGNVVDGIVDKNTGKGQDSSSYYAQIIKYLEQLKTANESQRETIVKNIQSYCLTLKKTALKAVTQANSVTTQLNAFINGDATQKIDGVLVIQNRLKDVQTFLNQNYGPNSQDQQDLNNQITDLKKQSDDLQNSKNKLKQKLKFLYFGALIGFLVYEIATGVEGKKIQKQIDDIQNQINGKQAELQRDTNITNMANSINQDIGQMLDQGQNAIPVFVKIQNNWQTIGGQMDELAESVAMLQNAADINIVILQLNQARQLWAQIRDEAIGFTMNTQASS

SEQ ID NO: 33 - protein, 326 aa, Bacillus sp.
MQKNKRIIRGILTLSIIAPISTSFLLTPLSSVNADQVNPTEKNIRVKTNTSMGIIKWEDLIFDNLHVIGKNSGLPGKYQDTISLSSGYFWDVEYHQFSVEADGSPIMTDSNDTFVAKTTLTNDTDQEQTLSTNAFSKTITNSVSNTTTHGFKLGAKATAKLSVPLIGEVGTELSTEYNFSDTLARSNSGSYTYIGSPQNIKVPAHSSLEVIVKLETVTAKGNVRLLTKISGRDRGNFIYTEPELADHFDLSFNQIVEKASQYKDFKNIVANPDQETITLIGTGEYESKYGTEFSVTVKPIYTNNREKREINEGYTYKVKPQIIKHD

SEQ ID NO: 34 - protein, 596 aa, Bacillus sp.
MKYNDRKDAKRKYKQAFLATVATMTLGVSTLGSTASAFAEEKKTEVQPQQATPNSNSLGAGGGSYESDALKALTDKINMDYLKKAGSVAADTLKAAYKDAHTSNGNYNNTFRTLTMTTSALIPYGGVLISPIIGLIWPEDLTAENNKMAALIKQLDEMMDTKVTDHVVRRLKTEVNDVKKQLELFEQNVNTGKHKSGSGLYSLTEEDGNAIDAKDIHKAFNSLLEHSKEEMQEVAALPIYTAMATAHLEFLHFLEQNGTKPIIGFTSNALNNILKTREGLENETFGQKIKDLADKYTKHVQETYNIGRDKYMAKMQAITTHSMNENDEYANLAYLKSLDDARSEMGYSQSKIDKIKNDIKNYQNLIKEKADFRDQTAENVAFKLTAMGKWNHQGDKWYYINNQGENQTGWLQDGSKYYYFSPEKTDKFEKGQMVTGKVTIDKGETYYFNPHGGQMQTGWIQDDGKQYYFSPANNTKNYDSESFKEGQMMTGWLAHLDHYYYMSPGDDKTNPYQKGKTFKKGEMWTGWLENPKKANEWYYMTPVARDYKVPHLIGNDDHIIRPVGSMLHDEYLEKQDSGDGWRYYFNESGINTHRYN

SEQ ID NO: 35 - protein, 331 aa, Bacillus sp.
VKKYKKLAVVMPLASLLTTGIGVLERPSSSFADTIPQKKLIQMQTTYLMTDQQAKDQAKQEVAQVNKDLSSLVGYSVDHASFQLISTNANTIELTSAEATGDSNIELGNYHNGTDLIQDYKVPGKKETNTSSATITNNEDASIGFESDTEFEIGIPLFAKGKETLKFTTNFKYSHGDSRTSTTTEEVTYPEQVLKCSPHGTTKLVSKVQKTNFTGKYSGKALITGVKDADGKSLNSEELFTLYTLNLAVDAAAHFGDPNYEGMKIPDSLEVDWQNHKIYAKSITTTFQGVAGHSSDANVEFIPDDKANQSVTMALSEYNRRIAAGISLYTK

SEQ ID NO: 36 - protein, 350 aa, Unknown
  organism from environmental sample
LVGNTQQDLCITSLYNKNIDGSKNIKKGGKFMTIVDIEQKAYEELKWYAIRELNAQANSFTNPSLYSYNINNADAVPDIVNFKSNPQILLTSVQVLSNDTSIQQSQTLKFSQKCTETTTTSTTTGYKIGTSIKSTTKGKIKVGFLMAGEIEQTVEVSLTGEYNHSTTQTTTSSHEELWEYTQPVLVPARSKVIATMYIMGGPVTVPMTLSANIAGTGVSPKGSPYSLSKIYFKKQNSSANSSLSARASVLYNPNWPGYSPVFTGVGENYSLNVEGASISSNTVSLYSYVEFKEYPLSTDTANLVAVPMREYYSTPILRDGTPALNPADSFTPYSRFASVDHNAHSMSEEE

SEQ ID NO: 37 - protein, 404 aa, Bacillus sp.
VKTKKWLRTLPAVCLLSSAMLTVPTSSFAAIDMSSCTKKDYNQSCVEQTDPGVNNRTYAMYETINRLVEEDTLNEQTNWSGKSWYNFIRFNYLILPSQEQEILHQLNRIDPSNVELSEVLRAINGYHNKTNLIQDYANTLKTTDLNATEYVEEPTVDSTSLQYKELNTVLKNPSNEALTKTGQIIGQKITSSTQVTNTHSIDVGRKFSMKNSVNIDVAKFIKAGVEITDEIHANYNYTNGTTTVNTKEDSVTTSPESVFLKPHTGAVITAKLSTPAYIGQLKGEMALDGYYTDQVNFYPTWVQLGIYNKFKVIAMHNPDIWEKLQELHFSLDDTYKKVNFEGKLTVSERKAPGSSFESSTQIYELDAKGDINYNKPVGVPDTKTGEVDIQLDMKKQKTLYLRTN

SEQ ID NO: 38 - protein, 1291 aa, Bacillus sp.
LTTLNELYPSYHNVLASPPVILADDPNSANGFKDMLKKLDDTWGEYDKDFLPKPVTASLSSLIDLFNKKPGSIVQFIQTGIRLAFLAVPGGQTYAWALNKIIGLCFPTSQPNLFEQIKEAVQQLIDTALVQTEINKNVNALNGMTLPIRYVSDAMQQAIGKPTFSSAYAGTDGCSTDASFSSTVYASSCDSTECSCSDAPDRNFCTADPCPSPCKCRLDAVYNQFDASRKTVENILTGMRTNLTTVLKPEEMTQYMQAFLPLYVAGATIMLSLYRSYIAFAQRYEYALGPNDTTKTTNDQLRVKISEESKYVYEQFSKYLPAVDSNTKGKLNAYIQYTRNITINALDQVSTWPFFDTWDYPSSDKAGTLSRPLSLAFNPTRIIFNDIVGPVECKTGSQDSSLLNLNPLYDIDGKALLINTITNYFYDNIQLKSLNFQTYNHDDNIYHQHFPLGFQATYSTRDNSTLKVNHTVPDGSNISLGNDIFGSYPAFNIINMSSSQLNAGLAYSDVSNISFDTFIPAGCSSQNKVSYPDHRIQAIYPVIPDSASRKKYDSYGNSDKPGFITTLIPNDTTTWITFTNLGINTFSAEQTTNTSGTKLVEYMNGAAALKLQPGQFAQYSINTSLFVLPSDFKYQVRVRAATTATGSLSIQVGETPAQTLQLPKTENQPGGIVGKQGTYMPIPASHSMDLTQRDTNLFTVPSTSSLSMSITNNSATDIILDRIEFIPLQAITPSNMSPRQFGPASTEQTETVAIRMDVYYGIKDIQAIVSSGGYAKFRYSRHSRRGSFIVYESTTDSNTWDYDGSFDTMDIIYLGTVNFLGGLIDYYHPSTIEDLENVTEQVYALFTSSSSTELAPTVSSYQINQVAMKVRALSDEVFCKEKALLRKLVNKAKQFLKARNLLVGGDFETLNKWLLGTQAIINDDSPLFNGDYLFLQPTNGIYSSYAYQKVDESKLKPYTRYKVSGFIGQSNRVELVVSRYGKEIDTILNVPYAAALPITSEPNPSCDNSQPDSHFFSYSIDVGPLHPELNPGIEFGLRIVQPNGYATVSNLEIMEERPLTDKEIQTINRKDQKWEKSVEQERAKISALLQPTIDQINSFFKDADWNGTILPHVTYQSLASVVLPALPKLRHWFMNDRAGEHYHILQELKHALDYVFTQLEEQNLIHNGNFTNGLTDWLVEGDAQITLLANNKPALQLSDWDASASQSLDISDFDENKQYKLRVYAKGTGTITVENCEESNPVSFDTDTFTSQEQIFYFDTPSFVLRMQSEGTEFVVGSVELIELSDEDTNE

SEQ ID NO: 39 - protein, 728 aa, Artificial Sequence
  Synthetic variant of native sequence
LTTLNELYPSYHNVLASPPVILADDPNSANGFKDMLKKLDDTWGEYDKDFLPKPVTASLSSLIDLFNKKPGSIVQFIQTGIRLAFLAVPGGQTYAWALNKIIGLCFPTSQPNLFEQIKEAVQQLIDTALVQTEINKNVNALNGMTLPIRYVSDAMQQAIGKPTFSSAYAGTDGCSTDASFSSTVYASSCDSTECSCSDAPDRNFCTADPCPSPCKCRLDAVYNQFDASRKTVENILTGMRTNLTTVLKPEEMTQYMQAFLPLYVAGATIMLSLYRSYIAFAQRYEYALGPNDTTKTTNDQLRVKISEESKYVYEQFSKYLPAVDSNTKGKLNAYIQYTRNITINALDQVSTWPFFDTWDYPSSDKAGTLSRPLSLAFNPTRIIFNDIVGPVECKTGSQDSSLLNLNPLYDIDGKALLINTITNYFYDNIQLKSLNFQTYNHDDNIYHQHFPLGFQATYSTRDNSTLKVNHTVPDGSNISLGNDIFGSYPAFNIINMSSSQLNAGLAYSDVSNISFDTFIPAGCSSQNKVSYPDHRIQAIYPVIPDSASRKKYDSYGNSDKPGFITTLIPNDTTTWITFTNLGINTFSAEQTTNTSGTKLVEYMNGAAALKLQPGQFAQYSINTSLFVLPSDFKYQVRVRAATTATGSLSIQVGETPAQTLQLPKTENQPGGIVGKQGTYMPIPASHSMDLTQRDTNLFTVPSTSSLSMSITNNSATDIILDRIEFIPL

SEQ ID NO: 40 - protein, 1176 aa, Bacillus sp.
LEFKFEWRYFMNSYNKNEYEIVDSPYSSNNSNLYTNSRYPYVNNPSQFMQNTTYEDWLNLCKDNSKYNQDTNGFIDTPDTKTAVTAAITVVGAILTYAGVPGAGAFTLLGKVVPVFWPSASDKSQNIWVKFIESIQDILGKKLDINKRNKAIDKLEGLQSVIYNYNASLKSWLENKNNSSFQTDVVKGNFIYANNAFIESMNVFTSSSGNSKEKEENVLLLPIYTHIANLHLLLLRDASFYGKYWGFSGAEINDFYSKQQQDTITHIAHCIKYYNEGLTIAKEAFQLEDKWNKFNSYRRNMTLKVLDVISLFSTYDTKRYPATIEKPNINELGKFELTREVYTDAFSDPGSSLNSSLTMDELDKKFTRGPHLFDQLIKLFLYTRFSHDTFGFTGNKNCTALINNNFCQEAQYGDIQKADTESTFSINQLINKINVTHVRNNPGAIIRMDFYKEQNLLFQYNSGSKATLVDVKTVQISNQIDSSIPNSETYKHNFSYLKTGNNPTNPNLKIRQVAFAWTHWSVDSNNTIQEKVITAIPIIKSQSVNDTTIIPNPGHLGGDFIQFNPGTSPRIELQCRASNFPTTKNYAVRIRYVANQKFTVSVSIAGRATTFITADTMAASTQGKYLYQQFSYGDVFTKSLPVPLSPRQLLTISITTLSPINQNTIFAIDRIEFIPVDEFPTLTTEQQSIETLQNQINNLFTDYTQNTLKSEVTDYQIDQIATTVDTVSEEQYSQEKMILLDEIKHAKQLSYARNLLQNGDFQDFLGWTTNNEVTIQTKNPVFKEYALYMPGARVINTSVFPTYLYQKIDESKLKPYTRYLVRGFIESSKGLEVSITRYNKDINTIMNVPNDVITIQSYEQTENTTTQVLPNSIRSQNSCTCEITTLPAICQDPHAFSFFIDTGDLHYNENLGISIGFKISNPDGYATLGNVEIIEGQPLVDQEIKYVTEKENKWKQINKQQQIETEQTYSEAQQAVNNLFLNGPSSMLQFQTTQLDIIKADNLINQIPYVYNAWLPNEPGVNYNLFMNLKNQISQAHALYTNRNIIQNGNFMNDTTNWFTSPDVNIQQTDDGSVLVLTNWSAQASQTIQLQSNHRYVLRVIAKKEGGGTGYVKISDCTNQIQKLEFHTYSNCDACTDFLDYVTKDIIITPNTNQIRLDIGETEGVFKIRSIELICS

SEQ ID NO: 41 - protein, 676 aa, Artificial Sequence
  Synthetic variant of native sequence
LEFKFEWRYFMNSYNKNEYEIVDSPYSSNNSNLYTNSRYPYVNNPSQFMQNTTYEDWLNLCKDNSKYNQDTNGFIDTPDTKTAVTAAITVVGAILTYAGVPGAGAFTLLGKVVPVFWPSASDKSQNIWVKFIESIQDILGKKLDINKRNKAIDKLEGLQSVIYNYNASLKSWLENKNNSSFQTDVVKGNFIYANNAFIESMNVFTSSSGNSKEKEENVLLLPIYTHIANLHLLLLRDASFYGKYWGFSGAEINDFYSKQQQDTITHIAHCIKYYNEGLTIAKEAFQLEDKWNKFNSYRRNMTLKVLDVISLFSTYDTKRYPATIEKPNINELGKFELTREVYTDAFSDPGSSLNSSLTMDELDKKFTRGPHLFDQLIKLFLYTRFSHDTFGFTGNKNCTALINNNFCQEAQYGDIQKADTESTFSINQLINKINVTHVRNNPGAIIRMDFYKEQNLLFQYNSGSKATLVDVKTVQISNQIDSSIPNSETYKHNFSYLKTGNNPTNPNLKIRQVAFAWTHWSVDSNNTIQEKVITAIPIIKSQSVNDTTIIPNPGHLGGDFIQFNPGTSPRIELQCRASNFPTTKNYAVRIRYVANQKFTVSVSIAGRATTFITADTMAASTQGKYLYQQFSYGDVFTKSLPVPLSPRQLLTISITTLSPINQNTIFAIDRIEFIPV

SEQ ID NO: 42 - protein, 405 aa, Bacillus sp.
MKKTPYKVMALSALLAVVTASNIVPTHTVAAENTVQTIQVSNMKKNMTSYKDFEYQLGPEGLREAMATTGSNALVMDLYALTLIKQQNADFTNVDIIDEKLRAAITTHQNVGRSNATKWLDMLKPKLITTNQNIINYNTKFQNYYDTLLDAVDATDKATLKKGLSNLNTSISIYKKDVDNLIAELISFRDRMATDTQNFKADTSSLVSILTSEDSGLPILQQQIDAYNAAIAKDNAIIIGGSVALGLGAVGIIGGGILIGTGAGSGLGVTLVVGGVSAIAGGTTAIVLAKQNIDSSREGIRDLTLNLNDTKAQMVVVNNIKNQCIYLSDTIDLAIVALQNISNQWHSMSARYTTLIENVDSINPNEFAFIKEDLHVASDSWKDIKEYADKLYTDIKVVETDGPEL

SEQ ID NO: 43 - protein, 370 aa, Bacillus sp.
MTNGNKNNEDSVQNEIKSIVDFPDFNIYKIRTNYNKYVDVSGDPNDNFAPIVQHDGHNGNNQKFLIYTLDNGYSVIAARHSGKVVDVRYINFPSPFPPPIKDHLIQHDFKNGDNQKFRLATEGTIEIQHDGQVWDVEGSGNKAQIIPYHYHGGSNQKFRLEKSGSVSIKTPNIEILPSAPDFKTDDLNEELPDETTPVVTHVTYLPYFMVKDSYYNPLQKIQDSPYYVLVRRQFWKKITHRKLAPSEAYDYEQITGVSRTDQTSMTETTEISIGADLGFMFKGFSLGLSTSITKALSVTKSTSNTESTEKKEGVFYKNPFNYQIAYARYMLINEYYVTRANGEMITTGDAAYWRVPNPERTVSQIIPRKS

SEQ ID NO: 44 - protein, 342 aa, Bacillus sp.
MKNIKNMKRKIAATSSIITLATSFAFTSPELAKADSNNIVNKVPEQQQPLKSQDPVSVPSEDVKGLQDLWQRKDIKTALAMVASVSFDDLRSIGGFNFLYYQKPSYSVELIGNPKNEPSSPVYLGTSNLSHSGGTSEQTLSSAAFSKAVTSTVSATTTHGAKVGAKAGAKLQVPLVAEASVELNAEYNFANAGTETNTETVTYTVPSQNVKLKPGETAKVTASLRMIEASGDVNLRTTYTGKVESNYERYIGHGMGEISDTNKSGLGSWIQALAFLDSDLNNYWSYSNSDHDVVYQDGKGKFKATYGTLVDIKVEISKETDSKDNTPIRSYSYTVTPEITKK

SEQ ID NO: 45 - protein, 326 aa, Bacillus sp.
MKKKNNKKTKQILSLAMLGAIGTSLAFTSPGSVSAAEINSIQSAAQEQGSVSISDWREPFRNAYKIAQKHDPYTYFGEDATEYTLGNVYQSSVEADGSPTITGSKSLFAGRTTLTNDSDQEQTLTTDQFSKTFENSVTNSTTNGFNLGVSASSSFGIPLIGETSVEISTEYNFSSTEEKTKSESYTYTASPQNIKVPAHSSVEVIVNLNTAKISGNVKLLSKIDGTFTHASGGDGSNTASRGLWVLEYDASPYEKLSDLKSARVGAEAYGPVYLVGSGKYSAEYGTEFAVTVRPVEKPNGFKSMIAENSKSTNEGYTYKVKPEIKK

SEQ ID NO: 46 - protein, 632 aa, Bacillus sp.
MNRNKDCNCNDGFQKSDMSDRYPYANDTKAALQNMDYKDWLVMNQGEELNGLDPKDGVNAAVAMVGTLMWTFGNPAFTGPLGGVICAFGLLIPILWPDDEEPQKVWEDLINHGDKFFDEKIGKIEKARAKTFIAGMKNELGKYEKALEDWKANKNQDTAATVQEEFDDAGDYLDTKMEELKIEGYEQTLLSCYAQAALMHLNLLSQGVQYADEWRKNNPGQTSKYWREMLTKGDKNRRGRIEAYMDYCTKTYREGLNKVKNVPNITWYTYNSYRREMTLAVLDLIALFPNYDVDRYPKGTKSELTREIYMDNGYTKDVDVGDLPELDQALTRRPHLFDSLAELKLIPSNVGLAHCLIKSRRINNDVLVGYDLPGSRHLSSLPIIGVNVEWREKHFHGGKLCDRANTGIEILTWIPDFGVTQSSIFKMEDGGGCIEHGNGIQPPRKNAKRDPLGGYSHRLSYMSVREAQNPSFYMYSYAWTHLSVDEKNTIAKDTITQIPAVKAVEQNNDFVVIAGPGHTGGDLVKLNGITKQGLKLKCVFPQNKKYKIRLRYAADNDTRVNIAVPDSDGTTAYWIDAKKTYPGVELKYNNFKYLDTDAIVNTPNKAVTIAIKNALKDTSIILDRIEFIPQEG

SEQ ID NO: 47 - protein, 630 aa, Artificial Sequence
  Synthetic variant of native sequence
MNRNKDCNCNDGFQKSDMSDRYPYANDTKAALQNMDYKDWLVMNQGEELNGLDPKDGVNAAVAMVGTLMWTFGNPAFTGPLGGVICAFGLLIPILWPDDEEPQKVWEDLINHGDKFFDEKIGKIEKARAKTFIAGMKNELGKYEKALEDWKANKNQDTAATVQEEFDDAGDYLDTKMEELKIEGYEQTLLSCYAQAALMHLNLLSQGVQYADEWRKNNPGQTSKYWREMLTKGDKNRRGRIEAYMDYCTKTYREGLNKVKNVPNITWYTYNSYRREMTLAVLDLIALFPNYDVDRYPKGTKSELTREIYMDNGYTKDVDVGDLPELDQALTRRPHLFDSLAELKLIPSNVGLAHCLIKSRRINNDVLVGYDLPGSRHLSSLPIIGVNVEWREKHFHGGKLCDRANTGIEILTWIPDFGVTQSSIFKMEDGGGCIEHGNGIQPPRKNAKRDPLGGYSHRLSYMSVREAQNPSFYMYSYAWTHLSVDEKNTIAKDTITQIPAVKAVEQNNDFVVIAGPGHTGGDLVKLNGITKQGLKLKCVFPQNKKYKIRLRYAADNDTRVNIAVPDSDGTTAYWIDAKKTYPGVELKYNNFKYLDTDAIVNTPNKAVTIAIKNALKDTSIILDRIEFIPQ

SEQ ID NO: 48 - protein, 218 aa, Bacillus sp.
MKMYNKRIIDLEIPSYNAINFLEIYRLPLVYLNQALNITQHLQKSLSLQTLNLEFDQLNNLISEIPGGSILNTINQKIEYSEINTKCAINNIVDIVKSNCEMFEDDFSLQSKLESVISNVFLNLANQEENPYVFYHEKLSYNTSYSYHVIFIIDNMESNLNVFPISFNVNVDSNYENLNRNSIKDLHSYKIKISGINFVISKNSELAEMVERVTESIL

SEQ ID NO: 49 - protein, 360 aa, Bacillus sp.
MKKFFKQICISIVILLMVSYVIPLHIFAQEQNIQGQQSNEKYALGAEGFKEEVGHSGSSILVMDSYAKIIFNNSQEIDFNGVNSISNELKTNIVSHQRAARNNAAYWLENIRPNMLQTVQDIVDYNTIFQVSYSTMADAIVQKNNKKLKVELENLYTMILENQKKSDELLTKLITFRDKMTVDTQNFKIDVADVSAILAEKETGIPLLKQQINSYNDVIKKNNDTILYGEILCATGLWIIGGPMIAVALDNIDDAEEEIQNLMSQISIAQEESICLTNIKNKVIYLTDTIDVAIDSLQNISNRWHTIGAKYNNLLQNLNLLDSNELTFIKEDLNTAKDSWQDLSDYAHELNKGIHEIEKN

SEQ ID NO: 50 - protein, 372 aa, Bacillus sp.
MKFKSTKLAICTMAAAALSTTIVPSTSVFAAETETQLNRSTENSYSLQKADAESYIDIVQDRMKQRDRESKCTGKPINMQEQIIDGWFLSRIWIFKDQNNSHQTNRFISWFKDNLASSKGYESIATQMGLNIESLNDMETSNINYTSKTGDTIYNGVSELTNNTGTTQKMKTDSFQRDYTKSQTTSVTNGLQVGFKVTAKGVLFLAGADFETSVNYNLSTTTAQTNTISDKFTVPSQEVTLAPGHKAIVKHDLRKMVYSGTHDLKGDLKVSFNDKEIVQKFIYPNYREINLSDIRKTMIAIDEWNHVKPIDFYQLVGIKNQIKNGDTIYIDTPANFTFNGANPYYRATFTEYDADGKPIKTKKLSENYKLKN

SEQ ID NO: 51 - protein, 305 aa, Bacillus sp.
VIGAISSSFAFTSPGSVSAAQIGSVQNIAQQQNAYIADWREPFEAAYKYMHNLHDDYFISETAEYKLTNVYQTSVEQIGSPTITNSSSLFVGRSTLTNNTNQDQTLTTNEFSKTFENSVTNATTNGFNLGASASATFKIPLVGETSIELSTEYNFSDTKETTKSESYTYTASAQNIVVPANSSVEVVVSLNTAKINGNVNLLSRMDGTITYDRSLNGGYNSSKFTESLGSFTKTALLWGSQPGLRVDNNNNLYLVGKGTYSAEYGTEFLVSVRPVEKPKGLAATPSKLNNEGYTYTVKPEIKKEQ

SEQ ID NO: 52 - protein, 547 aa, Bacillus sp.
MEHTDKNRNEPQQATPNPQGASGIRSNASISADEKDKNAIQQKSPNTYYEGTQENLGPLAQFDTWVQDLGKRNYKHTVAMAEKLLPTIYKDLNRGNFNNTARCITMLSTALIPYGVAFISPIIGILWPENGPNIKEMLQEMENKLVRIMDEKIEAKDLDDLEAAVKGLMVTLKEFENSLQGNIGGENYSAPADVDSLNRGRITAIQKGFNDLISAASKPRFKITELPIYTIIATAHLNFLHTVEKQGTSPKINYTEAALKDFLQNMKKNHKDYANYIEKTFKEGETRIDSKLEDKQQIEKELDKVHEQLSALGPKPKNHTHIEENRYINKKEELYERARSLKERLSKYNELMYQKSDFYSKTKGSTAFQIASTGKTTANPSWVNTEGSWVHNGFWYYIDAKGQVKTGWFNNKAPDGKDRWYYLSTGTTGLDSVRGNSLLPKGTMLTGWFHDTRKDKQMIGVNTKTTNEYWYYLSPEKNLKNSAGELFNLGQMMTKWVEIKDTKTGEPQWYYFNPEDGSMIHDKKAVQIGNLKYDFDSNGVCTTPNGY

SEQ ID NO: 53 - protein, 348 aa, Bacillus sp.
VSLSKKTKIFTVFALTGSILGSTLTLPAIQTVFAAANEYQFLTENDLRNGVKQAIPSFLDKNKPYGMYVEYNGSKWKRVIDPKELDQWYQYPQLVNAVKDIFRASYTNYVGLKDLTIENQDSKITSLRKVGDPELIQLGTSELVNTDSETKQNLTSAPFSKAFTSTSTVTVTRGVNLGFKVGSKIAIPLVGADISTEFSRNTNWSTNHTTTSTSTDTYTAPAQTISVPPRTKAIVTYVLSKQQYEGEIALKGDLTGSMFLYDPYIVAYPGMPEQQRLLYTSTLYNLFDKSGVQLPAGLSLDRGNQKIKFNGTAKLKVYGGQMHDVVLKIVSLDDPNKVIEERKIPKKN

SEQ ID NO: 54 - protein, 1243 aa, Bacillus sp.
MNQNYNNNEYEILDHGNRSYQTKYPFAQAPGSECQKPNAKDGIYTPVGRVDTVLQTIDIGLSVRTAISILQMLLSVSFPALGRAAGLINIIFGFLWGTLGGQSVWESFMKAVESLVNQKITDAVRAKAISELEGVQNALELYQEAADDWNANPDDASNKERVRRQFTSTNTIIEYAMPSFRVPTFEVPLLTVYAQAANLHLQLLRDAVKFGNEWGMPSEEVEDLYTRLTRRTAEYTDHCVTAYDKGLKGAYDLAPNPTDYNKYPYLNPYSKDPIYGKYYTAPVDWNLFNDFRRDMTIMVLDIVAVWPTYNPRIYTNPNGVQVELSREVYSTVYGRGGSGNSSVEAIESQIVRPPHLVTELTTLKIEQGGTLDMEQIQYPKYMKVTNTLHYIGSSSTWEQSSSAIPIRPITKIHTIPANNIGNLSLSQLEVPYRFSFYNKDDALISEIGAEFPPNNVTWNGIPRAEDSDQNSHHLSYVGALSTQSSAGFPWTYPTELLGEWGFGWVSNSLTPENKIVNDKITQIPAVKGYLLELGGIVIKGPGSTGGDLVQLSSNQSQVKLNMISPLFTPELTGHYIRIRYASSADTRLYISWGSRTGYYDAKATYSEGPLTYKTFGYMNAGWLYMTGAGGNNFTAVIKNQGDTPIIIDKIEFIPFTGLYLEDQALEKARTAVNALYTSDAKSALKLNITDYAVDQAVNLVECVSDDFHAKEKMILLDQVKFAKRLSQARNLLHYGDFESSDWSGENGWRTSNHVHVASDNPIFKGRYLHMPGATSPQFSNNIYPTYAYQKVDESKLKSYTRYLVRGFVGNSKDLELLVERYGKDVHVEMDVPNDIQYTLPMDECGGFDRCKPVSDQARSPHTCTCNDTAVTHTDCQCKDKGNRTSPNMYTNVPTGSAVYRNGSPDHKSCGCKNNGMYQNRTHPHKSCGCKDPHVFTYHIDTGCVDQEENLGLWFALKIASENGVANIDNLEIIEAQPLTGEALARVKKREQKWKQEMAKKRLETEKAVQAAQGAIQPLFTNAQYNRLQFETLFPQIVRAEKLVQQIPYVYHPFLSGALLAVPGMNFDIVQQLSALFDRARGLYDLRNLVQNGTFSSGTGNWHVTDGITTQPEGNTSVLVLSEWNHEASQQLHVDPDRGYILRVTARKEGAGKGTVTMSDCADYTETLTFTSCDYNTVGIQTMTSGTLSGFVTKTLEIFPDTDRIRIAIGETEGTFKIESVELICMEQMEDHLYDMAGNLEEEM

SEQ ID NO: 55 - protein, 655 aa, Artificial Sequence
  Synthetic variant of native sequence
MNQNYNNNEYEILDHGNRSYQTKYPFAQAPGSECQKPNAKDGIYTPVGRVDTVLQTIDIGLSVRTAISILQMLLSVSFPALGRAAGLINIIFGFLWGTLGGQSVWESFMKAVESLVNQKITDAVRAKAISELEGVQNALELYQEAADDWNANPDDASNKERVRRQFTSTNTIIEYAMPSFRVPTFEVPLLTVYAQAANLHLQLLRDAVKFGNEWGMPSEEVEDLYTRLTRRTAEYTDHCVTAYDKGLKGAYDLAPNPTDYNKYPYLNPYSKDPIYGKYYTAPVDWNLFNDFRRDMTIMVLDIVAVWPTYNPRIYTNPNGVQVELSREVYSTVYGRGGSGNSSVEAIESQIVRPPHLVTELTTLKIEQGGTLDMEQIQYPKYMKVTNTLHYIGSSSTWEQSSSAIPIRPITKIHTIPANNIGNLSLSQLEVPYRFSFYNKDDALISEIGAEFPPNNVTWNGIPRAEDSDQNSHHLSYVGALSTQSSAGFPWTYPTELLGEWGFGWVSNSLTPENKIVNDKITQIPAVKGYLLELGGIVIKGPGSTGGDLVQLSSNQSQVKLNMISPLFTPELTGHYIRIRYASSADTRLYISWGSRTGYYDAKATYSEGPLTYKTFGYMNAGWLYMTGAGGNNFTAVIKNQGDTPIIIDKIEFIPF

SEQ ID NO: 56 - protein, 282 aa, Bacillus sp.
MNTIENTEFQSNDFELTCNHSHHRSFSKFRHITLTIPAEEQYNFSDVYHVQPQYLPQALRLTNAFQSAINPDDLKFDFETALAIAKEIPNSGIINTMNQNVVQEHLQISVMIDQIKELVKTILGLSISSVSFWSAVAGAITNTFTNLNTQQDAAWILWEREESSNTSYYYNILFSIQNEETGGVMAVLPISFEISVNVNKESVLFFTIRDSARYEVRIKAITLAQALDPINRHLRHCSDIFDMHKDNPYIEEINTVKNKRLIDHIIHKPVRSNGLVLPDSCE

SEQ ID NO: 57 - protein, 311 aa, Bacillus sp.
VNNKLLVSGVLISTLFGGAINNVHADTIKNDSNFLNTKLGQVGQEGALQDIDNILNQLVDSINKNSPLMTHIALADNGIVNYSGININQSNVTNVIPLFLGNNTFSNTSSEEQSYNTSIFSQAITYTKSTSIQNGFKTGLKVGGKAGIPFVAEGAVETSLEYNFSSTGTSTSSETNTITAPSQPVKVPAGKTYKVEVYFEKKSTSGTVDLFADVNQGVRGNRLHPDFAKLSHFLYRAEDKHGVIQTPNDPDSIRIKGSGNFRIEYGTNLIVKTYDISSKPNLKFRSLINSELESDILVNEQIIPLKSPNKK

SEQ ID NO: 58 - protein, 307 aa, Bacillus sp.
MTIIDMGAVAEEYMRWNFSRDPDVVPGSPRYFNLFDGDIYDNRAEPTQDTFEVTPILAKTASQTLKNGTSVPQQQTVKFTEKKATTTKTSTTSGFKNSKTTKTGTKLNAGIKLDWFSAGGEFSTEVSVTGEYNHSTTQEHTTTTESTWEVTQPVTVPAYSTVIAKLYIYDASFSVTCNLDGKIRGTATSPIPTYNDYMNMQYTKKSTNRTVTRWQYAGDMYNANWPGKPQSFIGRGSAGDYNSLYYKGAGVARVASGIYTEVEFIETRASGEVVSWKYGYIPNPDGSLLVVPQGSRGIEVLQGSQIY

SEQ ID NO: 59 - protein, 575 aa, Bacillus sp.
MKYKDRRHTKHKYKQVLLAAVTTTTVGISTLGSTTSIFAEEKEKNAVQQQNTVQQKISDKYYERGIEMEPLAQFDNWTQNLAKNTGAANYKNTLSLAEKTLPILYKDLKKGNFSNTARSLLMFGTALIPYGGAFISPVLGLLWPENVEDQKNQLQALRKELTTLMDQKIEDYDVATLKQQTKALINELRFFEDSVNGKYAKSPAVGGTIQETRRILAITINSKFKDLIELCEKEKQQVAELPTYTIVAAAHLEFLRFIEVNGKDPNKIHIDDETLKSNFVNQIPEFTDRYITHIQKTYTEGEQQFLDKMNDITTHSVSESENLRYLKSLDNPRDEMGYTQDKIDKIKQNIKDYEKYSSAKHTFMLNTISSLAYKTMLLTGWKQEGNKYYYLDKNNMKRTGWFIDGDQKYYLSPEKTGEFEKGEMVTGLINIKNTSDSPALTYYFNPEKGKKQGTLMMGWIKNGDNWYYASPRNGTKNWDNKSFDRGVLVTGWVKIDNEYYYFSPADGTKNDDGKEFKKGEMVTGWMNVNGAWYYLNTEKTYGLIGHMLHDQTASVKNKNGEYKQHRFNENGTLAW

SEQ ID NO: 60 - protein, 631 aa, Bacillus sp.
MNKNSNNNEFTNNNGMVSQPKHPFVKEPGSELQNMNTVGAPIALSSTTTRDGVIIATGIGWAILGFVPVVGPGLSAAAGLLNVIVPFLWPEDDAGSSQISWEQLMDSVEELVDERILTSKRSDATARLEGIKALVNEYTQAIDDLKADPNNELKKDRVRDKFDDVEDYVKVSMPFFRAQGFEVPMLAMYAQAANIHLLLLRDVVQHGASWGFQQYEIDRYYNHTGLTGSPGMLQLLAQYTAHCVRWYNTGLENRRATNDWNKFNDFRRDMTLMVLDIISLWPTYDPTHYAVPTKTQLTRTVYTPWIGHLRNRWQGYPDALSLSVVENSIVPAPHLFTWLREVWFYFTGGGGPEAETLFTGFRPFFQTTLSDNLLTGELQGNYGTEPRQDITIPSPQSGDDIWKVHTSSTLMAEGPEHRRLKGWWFLFTNSPTQQAHTKTAYWQQLIYTHLGLPCKNSCGDENPNLSNPCDNSSLYSHRLSNFRGNFDPTYCSYGWTHVSADHNNLIDAQKITQIPAVKASSISGGARVVKGPGSTGGDLVELDFSTASSLRLKVTLADTTKSYQIRTRSAYGSVSKSADTLTYSDFSYANSTIIPPRDSSEYTYIMELDPSDFGGLEGKFFIDKIEFIPIG

SEQ ID NO: 61 - protein, 630 aa, Artificial Sequence
  Synthetic variant of native sequence
MNKNSNNNEFTNNNGMVSQPKHPFVKEPGSELQNMNTVGAPIALSSTTTRDGVIIATGIGWAILGFVPVVGPGLSAAAGLLNVIVPFLWPEDDAGSSQISWEQLMDSVEELVDERILTSKRSDATARLEGIKALVNEYTQAIDDLKADPNNELKKDRVRDKFDDVEDYVKVSMPFFRAQGFEVPMLAMYAQAANIHLLLLRDVVQHGASWGFQQYEIDRYYNHTGLTGSPGMLQLLAQYTAHCVRWYNTGLENRRATNDWNKFNDFRRDMTLMVLDIISLWPTYDPTHYAVPTKTQLTRTVYTPWIGHLRNRWQGYPDALSLSVVENSIVPAPHLFTWLREVWFYFTGGGGPEAETLFTGFRPFFQTTLSDNLLTGELQGNYGTEPRQDITIPSPQSGDDIWKVHTSSTLMAEGPEHRRLKGWWFLFTNSPTQQAHTKTAYWQQLIYTHLGLPCKNSCGDENPNLSNPCDNSSLYSHRLSNFRGNFDPTYCSYGWTHVSADHNNLIDAQKITQIPAVKASSISGGARVVKGPGSTGGDLVELDFSTASSLRLKVTLADTTKSYQIRTRSAYGSVSKSADTLTYSDFSYANSTIIPPRDSSEYTYIMELDPSDFGGLEGKFFIDKIEFIPI

SEQ ID NO: 62 - protein, 250 aa, Bacillus sp.
VNPFRYKTRLMKGECKMTSIYLKKNECIRNLRNPPIRRITLKVPCKNKGNLKNIFQVEPQYINQALTASNAFQGAIDSNLHFNYERAYQIGVNMPGRDYDPSMWGINQPVIQETLQVSSMINQLKSILNRFLYFIDISDEPFWNEVEAVIVNTFTNLYTQQNSAWIFYHSSTSTSTSYYYNIMFALQDSNYRTMIVIPIAFDITVRLEKQKVLFITLKDRAEYRVTLKSIWVRLILQKNQDKQIVDCFNS

SEQ ID NO: 63 - protein, 388 aa, Bacillus sp.
MHSITRYKKMGIIVPLVFVLGTSLTVVNKPIHAAAATNNITISQASSDTFKEVNISTLRGDLYERFVTLFEGNPRLLGINSDGKKLTDKDKQQIRSFAQAIRDDNFKNIDDIDKLTKGQFKKGTFIAPFMNWSPQYSNLTTNYDLKATPGDVKHESVEVYKYKNPKNSVEQTFKTDEKEVEIGHTFTETHATGGKFGYSNTTTFKVGVPLNQATTTHTFTFEANYNYTNTHTKTDKETKRYPSQTVKCEPGYITQLTIDKSTATYFGELEFNIGSSAKELMNQINQNIKDINAFSKNKLSVIQPDEEELMYTLYKYSGYDIPSYVTLDDEHKTVSFGKIKSTYTGVTGTASDMILELTPIDSKDTTKKSIKMPFKEYQQKRKNNEPII

SEQ ID NO: 64 - protein, 461 aa, Streptomyces sp.
VGADLERAPARRAPDPPRRHTGRGVRRAPGGHRGRGSRPAPRRRGRPQRHPPLHRDDGRRRPQGPPVRRGGGGLGRRPRRGARPAPPRRHPGLGAAARPPRDGAPGDDRRRDRAGRGGRRRARGAAVAGPPAPPQGPHLPDPRRRPAVAGGPVVAGGGRGARPGGGVHRHRARPHREQHPGPPRRGEEGPEAAQGAAGREAGEVREAGRRFPDRGPPLGVPQGRRSLRPEREAAPRPRLSRPHGGRPAPGPPRLGILTPPDHRDHPGGALAASFRTVVEVAPDHLDQARSIDRVFQEAIAPATVNFDFEAIHRAASAVPDSDVVKMVRGWGLQEYAPVLVMVLSLKEAVRQALPPECAEAGFWATVERELVQAFTGLAAQEGQPGLSFYEESGDRTRFYRDLFFALQDEETGDHMYALAFCVDVTVELPKAETLALDLTDIVPFAVRLNAIVVRQALSVAV

SEQ ID NO: 65 - protein, 362 aa, Bacillus sp.
MAIENNRYYYIKYFNSTNWVWDIQGESQDDGGNVILYDKKNSNNQQFVMFLLDTGYAIVNKNSGRVIGTEFPGSSGPRYYFGGNKLLYQESWKGNPIQQFLFKEQTIPGFTNVYLIQNQGLGLAASYAEQAGIPFAFVDLDPPNPNDGQQGFQLIEGDAIDLPSLPPLQSGRPPVPDYIFSVYDVLPQTSISYLVGATLIPCIMVNDNQRSPSTKIQDSPYYLLTKEVYWDQEYSKVVTPSNPIKTTYKSGISNIDQTSMIDTLKISIGADFGFKYDAFSGSLKTSIEKTLQTTVSSTQTSLQEKTVEETLTANPNFSKTGITEYQLATKYTLYRADGSLVVEPWIVKDDNISVTQDFFQNV

SEQ ID NO: 66 - protein, 819 aa, Bacillus sp.
MKNKKQKVLHMTVAASVLATTYVPAANFAFAQEKQEQGLKETQVTPFNELKEKITENPNLDNSRMWNPYKGVDYVKFMNALNSNVWKPVLTDAVKNEGENVVPVLIKGAIVMGLSLAPPPLPMLGTVVDLFQFTDGKTDDAWSRTVEYVNKTIDSKIEQYHSYLMSSELVALGSSLGEYKRVLEIYETNKLTRVEDPAAGVREQFRISNDKAKAFIAKLQHPQNQGDTRYNVLTLPLFAQAANLHLALLRDAIVCDWGIDSNQLQGYKDELKKSIIDYTNYINKTYKEGLEQEKNKAADYSDPESYIQAGKSDVPVLRQWFPEVMKWNRVANYERQMSASVLDLAAVLPTYDPDNYSKQPIVKQSRPIFAPIIGIPGGLKSKDSAGTFGSYVFDVKNFDQINTELAKSPYDYLAYGGALNQIGIRTSGYIYGSSTNTTYYTNMTHGSTAGNQTNISINPNNPITSISGTAGTKPYTLSFQFADGGTTQTLGSNVPNVNCYAPFKFEYPGYQLSAVRVFGTSASTGDADAMVFAFRSTEIGDTHQLMANVPTQIPAEIGYGQENTLNEVINGQNAIEMNNGNTMKYSINSPKTQQYKVRYRVAANEESSVRLQNMDTNISKTTDTSNTSRNTVKGEYGYYKLVEGPTITLNKGINTVTLQGTKGKFALDYIEVEPIVQDERVYFEDFIGDLKSSWYGSNAGFAPGYGTVHENGELYTFINEKVEKYSQYTMRVKLKLNSNDPNVRENVRLFTDNAKGERITKEVTLKGGANYQEFKLEFMTNDNLDKTHIGVQKASGSNTVFVKDVEVIGTPNDNATPYK

SEQ ID NO: 67 - protein, 337 aa, Lactococcus sp.
MKKNRKIINTCVVVLVFGASFSPIARADGMLKNISDVNQDRIVDVSETMEFIAQNYYEIHMKDKLLLCWVSGSDGYMIRKLDKITPGETWSEIEQSSIQTSNLQLSPEHLENVQVSLLDNTLNINQAMSSTSYCKAVTNTSTTQTNQGVKASAEAKLLPIPLIMPDGIKLTADVNSSTDTNISKTTTETIIVPPQTVIVKPHHKVKVTAEFYTNKYSGDIIYNTKVNKSSTGLKVNAEYYVPFNPFIGWLTPNRHDTITLDNYEMYRGDDSSIEKRLIQAGVKFNADGSMQALCKTHFDSTSGSYAKISVIDVTNLSCPLILKEQVYKNFQTNNSNS

SEQ ID NO: 68 - protein, 518 aa, Bacillus sp.
MKYNERQKAKRHYKKTMFAVAAALSIGVTGVGGAMAVPTATYAATNAQKGTDIIQIMSDGSIKIVNDQLDKQSPAKILTNLGGSAFINLVKGAQNNGMTTVNNTARDIVMAGTSGIPYGGAIISSLIGLLWPQDGVNQMKQMMEEMAKMMDQKIEDFDKAGLNQQIKDAQGALREMELVLYGDGSGSTRSLPGTASEKAGLAHSKLMTALSAAQKEGYDRTELPAYTAAATAHLLFLSFMVENGESPLFKIDSDSMNRTYKIYLKEAISDYKTHINRTVGDGRNSLYQANYRIQEINKEIARLAKRQETSGPKGFLQLQDKVNEQLGYKNDVLKDKAKFDNYVNSTVNNAAFNEALNFAIDTATKNKISITDPRSQIANGVYVIASGLDNHMVLDNDNGTHHNVATYEEHDGKNQRWLISYEKNKQAYKIQNLGDNGPVLATGSSANYNVFGYEFSGSDDQYWIPESVGDGYYILKNKAFPDRVLDVSNGKIGNGTNVTIYPRDAKNPANQKFKFIAQ

SEQ ID NO: 69 - protein, 426 aa, Bacillus sp.
MKPNSPENQPPSPKWYKGDYDKYRDGYAYNENIGYENKNWMSVLRVTTKISQLSIPGTHGSTALHGVTGGSRWIINQRMSITTQLNSGIRYLDIRARRTGTAFAMHHGAVYQKKMFGDILNEVTAFLRQHSGETVLMRLKEEHTPEPGSQSFEEILKGYWDNPSYKNYFWQPAGSGNGSGVNANPELKDVRGKIVLLQQFSVSKAYGINYSNLEIQDHDNVRFSMDGMYAKWTAVKNHLIKGNSDQNKIYLNHLSGNGGPNGGCDPQFVASGYKGGGDDEPLMGIGSPSQYPDFPTENYRLYYGGMNIMTTQYIPRSGLEHTGIVAADFPGKGLVGSIIGRNYRHINNEQREISIGLVIPENSVAKVTVYSTTGATIGKQVMANTNLVELNVTFSFHIPDGVRYDKYTLEIFPLNTRKRELLAELF

SEQ ID NO: 70 - protein, 343 aa, Bacillus sp.
MKKYKKLLMVAPLACMLGTGLFTLPTASHADAAPVASVVNDQFGQGSTYSTENISNVLFVRLRAGIEASPELRQKFKIADDEKIQFETGEGGGTIGGDKVNAINYGLRDQLSKVTASSTGTNITVNPTTVTEVEAGKIELLSYRNDTPITQKQFTTEKQVKRVDTVTATNQYGFKLGFESTTSFEVNALVAKAEQSFKATAEFNFSHTDTNTVTNEETVTFKAQEVQAAVGGTTNYFTRVGKAEFSGSFQTDAALTDLKLKLPIVKQGNNETVVHTEEVTLTSQDIYTIFKNTPYIPLPAYLSFDDNGKKVLVKNVTFNYTGEMGYNTAAQAEFIPFDQDNPK

SEQ ID NO: 71 - protein, 366 aa, Bacillus sp.
MTNGNKNNEDSLQNKIKSIVNFPDFDIYKIRTTYNRYVDVSGDPDNNLAPIVQHDGHNGNNQKFLIYTLDNGYSVIAARHSGKVVDVRYLNLPFPNPNLDHLIQHDFKNGDNQKFRLATEGTIEIKHDGQVWDVAGNGNNSLIIPFRYHGASNQKFRLEKSGSVSIKTPSIVNLPPAPDFKTNDLNEQLPKETTPVVTHVTYLPYFMVKDRYYNALQKIQNSPYYVLVRRQYWDKITQRILAPSETYSYKETTGVSRTDQTSMTETTEISIGADLGFMFKGFSLGLSTSITKSLSVTKSTSNTESTEITKDVSYTNPFTYQIAYAKYMLINEYYVTRANGEMITTGDAAYWRVPDPEQTVSRIIPR

SEQ ID NO: 72 - protein, 304 aa, Bacillus sp.
VIVDVERDLIDNNEWYARVTYNANPSTFRNQSVYDMNVSDLDVVPITTEFESTPQLTNSASQIVRNYTSKDQSQTVLFSEKSIETFSRSTTEGYKIGSSIKSTTSFKVKVGFLVSGEISQSIEVAVTGEYNHSSTETTTTTNEKLWQVTQPVIIPPYTQVTATLQIFSGPFVVPAKTKATIQGKGTNNGAYNFASVITYTDYGGKTWTDRNRAQALYTDRGQWPGYKPIYVGGSSSTDPTGLLRLEGEARINAQVGLYAVTEFKESPLPGYADIGSNRTYYAPNIILGDGRIIPVPGYQRYLQR

SEQ ID NO: 73 - protein, 985 aa, Bacillus sp.
VLLTLYLFSKGILINNLSGVMNVLSNSMVPYNVLRNIKMPTISGTRWDKEMFSSALDNTSVLLNLIEKGINEGDDLLGLFSFIGLTALEAIPIVGGALSKLISIIFFSSKPSISYQKIWEELVKAINQIVDKKIEEALVSELIQELSGFANVLEEYRDAYDLYNGKRVFEIPDNLTPEEYLVTVFTAANLQFLQRIPRFQNPKFDVVFLPFFVHVAEMHILLIRDAAIHGLEWGMDEKMNQKFKKDLKNCIEEYTTYLLKIYKKGLKEASERELKDKDFPTTRDKKHYINTVRWNVINQYKRGMTLTVFDFAYRWKYYQEDYRNNITLNPIRTIYSDIAGSVYPYEKTTNEIDITIKDQNVKYRGLLKKLQVYHAERIDSIQSTYLRNHEIINSNKIGGTGGRISSLDLEDHINNPLIQVNMWSELVPISLGFKFYNEKEEKIGGGSWWPNPHKFGAYHFVGNKVSSIIGFGKNETGGFNSLDAMAVGFKLDDYDSKNRLFGINKNGEPVTKVIDAGNFYKDNFKSNIHKADEPIFGDGILQFTNYLSHQNQDSSVMYQIHVEIEGTYQLHAIIGAKKQREKLSIKVILNDEQQKNLITDYFDSSNTWTGMSLNNEWVYKRVLIGNFQLKRGINNINIHNSILQDSANIKTWNLGSIELTMDTNSIKDPDVTTLYDKDNYAGTKRFIFEDTRRLIDFNDRTSSIKVGSYVPGLRFYEHYDYGGGFIDLGSGEKLSLKNHRLNKKLSSAKFANLVLYKEDDYKGEKTLIFHDIPYLTDFNDKTSSLVVSSNVSGIVRLFEHSFYNGEYIDVSGGQKISLKGHNLNRRISSIKFLKEHEVFNGLYEIVTAINNKSVVDWSKDKNSNVHLWERRNQDNQKWYFKYDSEKQAFQIISKADEYEVLAWNDFKNSMNVFATYNSKKDEHYWILDYLGEGNYLIRNKKKQNLVLDVDGHKTANGTNIKVNEQHALDNPSIEAQKFKINLVDN

SEQ ID NO: 74 - protein, 340 aa, Brevibacillus sp.
VNCMELKRICKCLTISAVLSQIAVYPVTSYAVSNTEQNTDNMKITEEKSNMIRNGLLGNVHKSSVKSAYSSNVTNVDEQMNKISDFYYQNNLRGKEISTYYYVNQLKEKKTTMSLDLNASDINNVTYNDLQPEYIGENEFQNTTDKDQTFTTAAYSHAVTDTVSSTVTNGFKIGGSGDTIFKIPILLKDGIKLSAEFNSATSTTNTTTDTKTLTASPQNIKVPAGKTYKVVVNLYKKSFAGDIDFTGKATNVNSKLTVNATYVGPGFPRRDKEQSYTYATADMLKDLTNDQRNQITGISFDNNKNLTLNGKAKIEGIYGSKLQVSVYDITNNAHRLVQVF

SEQ ID NO: 75 - protein, 579 aa, Bacillus sp.
MEYTGKNINKAQQDNPPPQGAIATSAFAPEEDSVSVISSHTINIADTQTENLEKSFWQKATSEMTIKNGAKFGGTTLKEFLKFAKSNDSASANNALRAIVLASFDFIPYGMFISPIIGYIWEEQGGIKEQLTKLKDEINAETDKKIAQQHLIDLDSKFSDLLENLNKLENSVKSKKAEMYYDSQGSIEESRRIWVGIIESKFGEILTLAKQEKNKVNELPLYTQVATAHISFLKNLEINGPGPNYKFDPQSLKYFYNTKHIQETIDKYTTYIKNTFDDFHIKNIEKIYKVYGSPIDPYIFATSEGRELVKQKLNKLLLEAKATLDKINNETVWLGGWAAHGRSVEKATDELNNVKVAVNAADFSSKLFETTIADESFNTIASLGTWIEKDGKHYYNDRYGEMVTEWLNIGKKTYFFSPEDNVENLSGIKFKKGEMITGWVNTEENMESNQIRSYLFVDEEEGLKNSAGELFTLGQMMTGWHKTMDGKDKEFWYYFTSEEEGLKNSAGELFTLGQMMTGWHKTMDEKGKEFWYYFSPKEEGLKNFAGKLFTLGQMMTGTVKIGNKGYTFAENGVCTNPNI

SEQ ID NO: 76 - protein, 1192 aa, Bacillus sp.
MNKNYNEEHEIKRNVTIKYPFTQVSDFEVNTTNYKSWIGMCTRENSREYGKYNKNAVIIATGIGWAVLGFIPVVGPGLSAAAGVLNVVIPFIWPEEAGPPGSNQAQFTWEQIMNAVEELTDNKINSSIRERAIETTRILQSRMRDYQQAICNLKENTDKDKDKEYKEDVRREFNDAEDQLKSAIIQFSHQDENPDIEAEHNILLLASFAQAANLHLLLLKDVVQFGQYWGFTEEQVEQYYSNKSTSVGNPGMVQLLAQYTDYCTKWYHNGLNKLKPQNIDQKTWNKYNDFRRDMTIMVLDIVSLWPTYDPKRYPLFTKSQLTRQVYTQLIDGYYSEPNLAPPSLVKWLKEVTFYFREVSDEEQAWEKTRGQFVGYKMKFVTTMADDCYEIETPIVGEMGAFDDTVRFNGEVYKVSSINLKRESTIDQEDINLAHYLQKLELYFDSNVIFVIGTDYAGQNEFETVVINQGLACDNSVQEICEPCMSSCATSKDMSFPCDNLDLYSESLSWVGALYRGTNFPNRGLADWVFGWTHRSVDIDNQVLPQNITQIPAVKAKEIISGQVIEGLGSTGGNLVRLDENNQMLLGVTIVSDLSEKISGYYIRLRYASNQNNRLTVSYYFEKEQVDSIEFDVLKTYDGQDLWYCAFGHQTVMKIPNPKETKEYTIKIENKGNGSVIIDKVEFLPIEDTLEAYQENENLERARNAVNALFINEAKDTLRLNTTDYEIDQVSKLVECLSDELSTYETIVLLDQVKFAKQLSKKRNLLNYGDFEFLNWSGRNGWKASPHVYVKADNQIFKGHYLHMPAAIHSKLNDTIYPTYVYQKVDESKLKSYTRYLVRGFISDSKDLELLVERYGEDVHVKMDVPNNIFYNLSIGESTKHIKTSGSYKGLNAFSFYIDTGLVEIKRNLGIIFALKITSINGSANVGNLEIIEEQPLVGEALKRVKKREQEWEEKMKHQCYETDMVVRDTRNAINTLFTSLQYNELKFDTLFFHILKANNLVQQIPYVCHPFLMKGNPVVPGMNFNIFQQLLTLVEKAKELYYLRNVVPNGTFNEGIGNWCVSNGVRIKQEGNNAVLILREWQDKAIQRSPIDAEQGYFLRVTARKEGSGFGYVVIHDSDNMIEKLKFTSCDHDTDDTVSVDSLMGYVTKTAEIFPGTNQVCIEIGETAGVFKIVSVELIKTRDMKKYILDGM

SEQ ID NO: 77 - protein, 685 aa, Artificial Sequence
  Synthetic variant of native sequence
MNKNYNEEHEIKRNVTIKYPFTQVSDFEVNTTNYKSWIGMCTRENSREYGKYNKNAVIIATGIGWAVLGFIPVVGPGLSAAAGVLNVVIPFIWPEEAGPPGSNQAQFTWEQIMNAVEELTDNKINSSIRERAIETTRILQSRMRDYQQAICNLKENTDKDKDKEYKEDVRREFNDAEDQLKSAIIQFSHQDENPDIEAEHNILLLASFAQAANLHLLLLKDVVQFGQYWGFTEEQVEQYYSNKSTSVGNPGMVQLLAQYTDYCTKWYHNGLNKLKPQNIDQKTWNKYNDFRRDMTIMVLDIVSLWPTYDPKRYPLFTKSQLTRQVYTQLIDGYYSEPNLAPPSLVKWLKEVTFYFREVSDEEQAWEKTRGQFVGYKMKFVTTMADDCYEIETPIVGEMGAFDDTVRFNGEVYKVSSINLKRESTIDQEDINLAHYLQKLELYFDSNVIFVIGTDYAGQNEFETVVINQGLACDNSVQEICEPCMSSCATSKDMSFPCDNLDLYSESLSWVGALYRGTNFPNRGLADWVFGWTHRSVDIDNQVLPQNITQIPAVKAKEIISGQVIEGLGSTGGNLVRLDENNQMLLGVTIVSDLSEKISGYYIRLRYASNQNNRLTVSYYFEKEQVDSIEFDVLKTYDGQDLWYCAFGHQTVMKIPNPKETKEYTIKIENKGNGSVIIDKVEFLPI

SEQ ID NO: 78 - protein, 205 aa, Bacillus sp.
MNRGTISDKKKSGYSEEEYYLKLISDVKPEYTVQTLNLMDKFKFIVNPMTKELDTSKILQIANEHPDLAIVSTLNQQFTSNQKMPIKNLVDSSKKFVFSTIGDSYLDKGIKKTCINWIENVIVKLNSQIEHPWISFYTEAKNKTSYRYNILFIFQRASFLVMTPISFEITILASKDTVLDLKLTDKAEYHVSIKLIQVIQSLNPC

SEQ ID NO: 79 - protein, 463 aa, Bacillus sp.
VIDNNNQTTNIMDQFSDLMNEKIKNYNRQNIKATLKALHHELKALDDSLNGKRVSESYYASDSPDEHNRNRVRFIHSNFKALILQCSKEGYEEPELPLYTAVATAHILFLRCIEKHGLGPKLQFHISDYNEFMKDLKDYPDKYIKHIKETYPKGSSKLFKEPTLVPKYYAETKGNKAFWMAVKRNTLVPQNGKWYYLDRDGKMKTGWVKTGGFIMDDNGQLEMHQPDAYYYFSSNGPMVTGWFTDADGRTYYLNPEETQKFYKGQMAEGFVEIGKGKWFYFNPLDISRLAPNGYDNLPEAGKKLLKDTFGISKNILRGEQRTEWIHDNGAWYYCSPEKNNRFDKGQMVTGEVNIKNSEGNIKTYQFNNDGACTNTYQKMVLQYFMVVVPFFIAYQLFYTNEYLNLEIIFCPSKLFKTFFNLGELTYYFKRRSSLYLSNFCYPTITRILILLYIITLLKFYNYL

SEQ ID NO: 80 - protein, 323 aa, Bacillus sp.
MRNNKKWKRKVFSLATIATIGVSCTTLPNHASADTTEKVPQDVSKIQEQNKKQQGIQDWQGPIDFTIGQFFQKKTGNNVAHILTRYDNPKFIETTAVASSSPKITDLKEVYVGRSILRNNTDIDQTLYTDSYSETITESTTSAVTHGFNIGESTTASLSLPIVGAGFEQEVHMEYNISTENSTTKEKSRTYTAPSQAIVVPAHSSVEVIVKLDRIKADGKVDLFSKMKDTQYTSLVWFKDRPDQMFVGSVYDAVRDVTSDQTFPDIKANKKDKTISLIGKGNYKAVLGTTFSVNVKPVNKEGRAINDGYTYKVNPQITDVKIK

SEQ ID NO: 81 - protein, 270 aa, Bacillus sp.
MNIDALNKNEIKLSNANQNVCDNFLHITLNLPVEEEKNFTEIYQVEPQYLAQALRLANAFQGAIDPSDLNFNFERALNIANNIPNSAIVKTMNQNVVQQTVQISVMIDQLKELIRTVLGFAISSPTFWSSVEAAITSTFTNLNTQEDSAWIFWKSESSSNTTYYYNILFSIQNAETGGVMAVLPIAFEISVNLEKKKVLFLTIRDSARYEVRVKAITLAQALDRNQRNSTDIFNMHKNNPYQAIENKVFNEEMINQLMHKPVNTSGIILP

SEQ ID NO: 82 - protein, 1281 aa, Bacillus sp.
MHQNYSEEYEIMDTVGMNHQSRYPLAKAPGSEFQQMNYKNWLNMCVSGESGELFANSNTARNGVIIGTGIAWAVLTLIPGYGTGLSALAGVLNVIIPYLWPEEAAPEVPSQFSWEQLMTAAEELIDKKVDAYDRNRALTELAGIQQAIKLYQDAACDLKKDPTNTQLQDTVRAQFISTNTTIYNRMPTFRASGFEVSLLSIYSQAANLHLAFLKDGVQFGAEWGMDPTTVDRYYGYLTANTATYTDYCVYWYNFGLNALIQKANEVPVYSTAYWNKPNNFRRDMTIMVLDIVSLWPTYNPRIYPQTTKAQLTRSVYTPISGNIPRSFEQVDDAVIPPASLFSWLREVTLFRRAFATPTNEYTLFTQYAGYKMAFQNTLASTLQETPVFGERGDEVTSVGIGEEPNFEVYKMRNIILGPEASRSFESPQTFDFYFTPSGTVETVGINYAEIQEEPTNTTNQGLACISTKDPDTCDPCTTTCSVGPINPTIPCDSLTLYSHRLSRVGGVLGANPQSIIGLTYGWTHISADNNNTIDTEKITQIPAVKGFLLYGDASVVKGPGSTGGDLVRLSPSEQRSGLFRIGFTHPLIDTLPKGYTIRLRYTSNADVTLFSVLEIHSDEGMKDTNNTFTLPATSSNNSLNYNSFGYYTLSGLELEILPGYEQTPVLHLDHWSGGDIILDKIEFIPIEGSVEEYQANQDLEKARKAVNALYTSDAKSALKLNITDYVVDQAANLVECVSDDFHVQEKMILLDQVKVAKRLSRARNLLNYGDFESTDWSGENGWRTSQHVHVAANNPIFKGRYLHMPGATSSQFSSNVYPTYIYQKVDESKLKSYTRYLVRGFVGNSKDLELLVERYGKDIHVEMDVPNDIQYSLLMNECGGFDRCRPALSQTRSDHTCTCKDTTSMHTDCQCKDKSNRTATGVYTNVSPGSTMYTDRFHAHKSCGCKNNDMYQKGTHPYTSCGCTDSHVFSYHIDTGCVDQEENLGLWFALKIASERGVANIDNLEIIEAQPLTGEALARVKKREQKWKQEMVKKRLETEKAVQAAQGAIQPLFTNAQYNRLQFETLFPQIVHADWLVQQIPYVHHPFLSGALPAVPGMNFEIVQHLLTVIGNARALYERRNLVRNGTFSSGTGNWHVSEGVKVQPLQNTSVLVLSEWNHEAAQQLRIDPDRGYVLRITARKEGAGKGTVTMSDCAAYTETLTFTSCDYNTVGSQTMTGGTLSGFVTKTLEIFPDTDRIRIDIGETEGTFKIESVELICMEQMENHLYDMAGNLKEEVLLQS

SEQ ID NO: 83 - protein, 686 aa, Artificial Sequence
  Synthetic variant of native sequence
MHQNYSEEYEIMDTVGMNHQSRYPLAKAPGSEFQQMNYKNWLNMCVSGESGELFANSNTARNGVIIGTGIAWAVLTLIPGYGTGLSALAGVLNVIIPYLWPEEAAPEVPSQFSWEQLMTAAEELIDKKVDAYDRNRALTELAGIQQAIKLYQDAACDLKKDPTNTQLQDTVRAQFISTNTTIYNRMPTFRASGFEVSLLSIYSQAANLHLAFLKDGVQFGAEWGMDPTTVDRYYGYLTANTATYTDYCVYWYNFGLNALIQKANEVPVYSTAYWNKPNNFRRDMTIMVLDIVSLWPTYNPRIYPQTTKAQLTRSVYTPISGNIPRSFEQVDDAVIPPASLFSWLREVTLFRRAFATPTNEYTLFTQYAGYKMAFQNTLASTLQETPVFGERGDEVTSVGIGEEPNFEVYKMRNIILGPEASRSFESPQTFDFYFTPSGTVETVGINYAEIQEEPTNTTNQGLACISTKDPDTCDPCTTTCSVGPINPTIPCDSLTLYSHRLSRVGGVLGANPQSIIGLTYGWTHISADNNNTIDTEKITQIPAVKGFLLYGDASVVKGPGSTGGDLVRLSPSEQRSGLFRIGFTHPLIDTLPKGYTIRLRYTSNADVTLFSVLEIHSDEGMKDTNNTFTLPATSSNNSLNYNSFGYYTLSGLELEILPGYEQTPVLHLDHWSGGDIILDKIEFIPI

SEQ ID NO: 84 - protein, 609 aa, Bacillus sp.
MKNKPVKKAIAGTFIVTGLLSGASGIILPASKAFADQTSRLDDFIKNDEAGHYGKNRDGFYIKSPDEARVLPQGGSWFTHDTHYRDAEIAPFFLIDESKMDSIIKEVQNKKDMELTDLLEIITLHAPSKEMDGEDNDAHLVRYCRTPGIDKDVKNHEYLTVDTGKSKIVSTKIEKADAKDDVNLLTNTFTNPTDGPIQATSGTISKQFTNTISTTQTNATTLGMKQTLKTGIDFFDIAKEDFSLEFNESYTYTNAHQTLTSEATTLTSGSVSVNIKPGKSYKVQTMMRRDKESGIMQGTSRLGGEYTISNGDYRVDLNIYKKFKVIQDFYPKLWAVLKDRGIDLDDNTQEVLYTGGIGFDSIRGANIITTITDLDTGNKIEKPVSQVKATGTINLDGPIQASIQTGIAELEKNSLKLQTIDGVTYCVDKDGNHLTGWQTVSGTQYYFGHNGDGSGLIHEGEMAKGWKKLDGVQYYFNKTGDGSGMTHEGEMAKGFKTIDGVPYYFGQTGDGAGMNYEGEMAKGWKTIDGKTYYFGQTGDGAGMNHEGQMATDWTTINGVKYYFGKAGDGIASLAVGERATGSMMIDGQVHYFNKTGDGTGYHHEGELEW

SEQ ID NO: 85 - protein, 621 aa, Bacillus sp.
MKYKDRTHAKRKYKQALLATVATMTLGVSTLGSTATAFADEKQTEVQQQQADAPPSTGPVFKKEKDGTFTVLKKNIFNMATLKAIGSLGGAGLKQAYADYQVDGGNFNNTFRTLAMGSAALIPYGGVVLSPLIGLLWSEDKTAEANQLKKLMESIAAQTHEQIAKYDTAKLSKALQDLHEKVEEFENLVPIPGSGIFYSGDQIHKYENIQISAKNLNNYFRSAIAACQTEGYKESELPIYIILATMHMNFMNYVIKNGENLLHFDPEVLKSEFTDKQDGYIHGVHNVPGQSEKVGYIEYIHNFAKKDLDLTSNFERFLLDYKFKLDHDKALSIGSSPAKLISSIVMNHNNKLEKTLNNSINNIAFKQAANIKSEFTLDQNGRPLYYSLDGKMQTGWKEIGTSFATRHDTGSSTAERLFSREWLKAQGIQYSWYYFSPTKTDKFEQGEMYVDTTQTLPDGKTYTFDSDGKCLNPDGGAVNVQILKETYKIVSKLDNNMVLNTSDHQAVLKGTNEDTWGNSWTFQYDNEKHAYLITNGQSGGPWKLAEYSNTNTVFATDDKANKQEHYWTLEPGGDGYFFIHNKSQPDKVLDITGSNRAAGTKIGLFNKNGQDNQKFKLEKIN

SEQ ID NO: 86 - protein, 349 aa, Bacillus sp.
MVNNPFPLDTTYTIVNQELNLIFDLQKELNSNGTSIVLRLPNSRKSQQFIFFKLDGKLYAIANQQSGKIIDLKGSIDSYTLVQNTWNGEPSQIWYVKNTNISEPYYKITNQQNGKIAQAINHSNDTDNLVSLTSWNDQKMQQWNFTPKKSIKFPKNIESKPLPFPPDYFSSPYEVLPFQTTPVTVASILLPCILVTDNEWDDQTKIQHSPYYQFVKEQYWERIESITLEPGQTNTFQYKTGMKTTDQKSMMNTIGMSIGADLGFQFNQTSTKISTQFTSTLMVSKSTTSEQLTETTITDSLTNTRSTKIGITKYQLVTLYSLLRTDHSFVTEPWKVSDHLTTKDRTIIS

SEQ ID NO: 87 - protein, 1047 aa, Bacillus sp.
VHILFLSDEYVSNGGVYMAHLSDFYPISYNVLSQKSVYNDNEMYEVQQIFKNVLTSWEQYSQDGRISTQQQELKKAIHNLKKYNLDLFDLFINILPLGATISPLPPVHSNDVMISTIIPNICFIVDIVWPQIPKGLNTQLNMWEVIKDRVKKITNQKIEINNYEQILTTLNQVKIHLLDLKNAIQTTVDQSLSYQNITADNNVYHPYKDQEFNAIIRIQLANVLAQFDQYISIFQMNNCVIIELPYFCLLATLHLFTLQSVVHFGSQWGYSTMQIKDYSKKLQQKIKEYTNHVYSICINPSHIHRLNDSKNSLYKLDSLFSNMINECCNYIAIWPLLDPVDYPIRTHLEQIHIPFSNIITSENATFELNNHIQKKTFQSHNLSKKTNLNKIATIGEVDRNSGVIMIAGVPVVIGITNGQYVTEHITKTSAIKLSKNQIIELPFFNLTTGLYQIRYRLSTTESGFLHFKLGRWDNIVSLEQIETYNHSTLDFGGKPGIYKLPSKKVTPRCGNLSSIDNILAINSGHHILTISNIGSVNIVVDRIEFIYISNMDSPHSPMVFNNKKYLEKIKRQVNQLFTDTLKNKLKKEISDYHIDQIALKIDKLSNKAFQLEKKYLRQLINKAKRLSKERNKLVGGNFEKLDKWLLGYDVVKKYNKKICKGEYLLLPPPEKGLSYIYQKVDESKLKPYTRYIISGYIIQSENLELIVSRYGNEIQTLLNVPHINENTFHNQKHVNSHFFSYTIDVGMLHPEINLGIELGLRIVHPYGFAKLSNLEIRESHSLTNYNTLKRQDSLYVNKYQNQNRGLYRNPTYQINNMKIKDNHSLTMQEIIQKETIWKNKFDNENKKFIIDLTSIINQINTFYKDLNWNNTIHPHVTYQKINQVKLPKLSNLKHWFMNDRPGEHYKIIQTLQNALDCAFIQLENQNLIRNGGFTNGLENWTIQGQVKIVTFIPNKQTVQLSCWDAYMVQTINIKEFDTIHTYKLRVYGKGTGNIVIQHSDYVELMSFSTNEFIFKELLFSLKTNIIEVLIQSEGPKFFIDSIEIFKY

SEQ ID NO: 88 - protein, 548 aa, Artificial Sequence
  Synthetic variant of native sequence
VHILFLSDEYVSNGGVYMAHLSDFYPISYNVLSQKSVYNDNEMYEVQQIFKNVLTSWEQYSQDGRISTQQQELKKAIHNLKKYNLDLFDLFINILPLGATISPLPPVHSNDVMISTIIPNICFIVDIVWPQIPKGLNTQLNMWEVIKDRVKKITNQKIEINNYEQILTTLNQVKIHLLDLKNAIQTTVDQSLSYQNITADNNVYHPYKDQEFNAIIRIQLANVLAQFDQYISIFQMNNCVIIELPYFCLLATLHLFTLQSVVHFGSQWGYSTMQIKDYSKKLQQKIKEYTNHVYSICINPSHIHRLNDSKNSLYKLDSLFSNMINECCNYIAIWPLLDPVDYPIRTHLEQIHIPFSNIITSENATFELNNHIQKKTFQSHNLSKKTNLNKIATIGEVDRNSGVIMIAGVPVVIGITNGQYVTEHITKTSAIKLSKNQIIELPFFNLTTGLYQIRYRLSTTESGFLHFKLGRWDNIVSLEQIETYNHSTLDFGGKPGIYKLPSKKVTPRCGNLSSIDNILAINSGHHILTISNIGSVNIVVDRIEFIYI

SEQ ID NO: 89 - protein, 364 aa, Bacillus sp.
VNEMATLNLSEESKKFQSITFAESTEQYGLRQYPNLNENPTNRVFNDAYHKELADQYGFIFYKLDADDQFIIANRNTGEVLQAPGTTGPDSVVLHKQYDASIGQKITKKQLTKDNFQLYVYNSTGIISAPYDKVGEWVNIVSLPKNSNENNVHTHLKNRTDIKFEINIPSLSPTTKLEPIPELPGFNDPLPENEDAKRAVIGSALIPCVLVNDSISLADKIKEYPYYVLEYRQYWHLLWSDVFTAGSNKIKTEVTGIPSEAQEKMKEFVGASIRTDIGLRFNEKSEPFGKQITSGLNVKHSYDYELGETTTTTNVDNPNDFTVRYARYARAHEFVLKRSDGQVVEEPWVAIDENDMYLKMYKRA

SEQ ID NO: 90 - protein, 372 aa, Bacillus sp.
VVGEREMKRYKKILMVAPLACMLGTGVVTLPDAAYAAESLSSPVSFTNIYNDGADYTKENLAKDLRKRILWGIEETPELRQKFKLADDESIQRENPATSFTDPNGNTTEYPALYYGLEDQLSKVEVGVVGSHFEVNPTVDSYEDLGQTNLLTINNDDGTVAQTAQTPETTEKFSETMSYSNSTGMKIGIGTSTTIKIKIPFDLGEASQTVNMNSEFSFNNTQTQTSTHEKSVTFKSQPVVAAPGGTTTYYGTIKRAKFSGTFQTDAYVPGLTLKLPIVKKNNGNDIVHTEEVTLTPEDMYAIFKNGLPVLPPYLSLDDKIKKVKVNNASFTFNGEGGYYSAVQVKFIPKDPNKKAQVMPYKEYVAKTQEKSL

SEQ ID NO: 91 - protein, 378 aa, Bacillus sp.
LLIYICKILLKKGGLIMKFKSAKLAICTMSAAMISTAVIPSTAVFAAETQLNVGQKAVTPDVSSYIDIVQDRMKQRDKESKLSGEAINMQEQIIDGWFLSRFWIFKDQDNNHQTNRFISWFKDNLASPKGYDQIAEQMGLNIEALNDMDTSSINYTSKIGDTIYNGISELTNNTGTTQKMKTDSFQRDYTKSETTSVTNGLQVGFKVLAKGIIYLAGADLEASVNYNLSTTTSLTNTVSDKFTVPSQEVTLPPGHKAVIKHNLNKMVYSGSHDLKGDLKVSFSDKELVQKFIYPNYREINLSDIRKTMNEIDEVNNVNPVDFYQLVGVKNHVKNGDTIYIDTPAEFTFNGANPYYRAIFTEYDDNGNPIQVKSLGGNL

SEQ ID NO: 92 - protein, 732 aa, Bacillus sp.
MNNNQMNFSNDITDNSNINNFENKIQNNMENLHYEEVSDIVSNLEEKNGYDVPIENSSSIRDFEMTREAFEPYNVLAQPLDTRELDELRRTWENWEMEVSFLDTRIVPVVGVIGSFLAKEIAKIAGKKLLKSLLGFLFPNDNTEQFEAILEATEELVNRKVTEVIRDRVQQELVGLQGNIEVFLQDVEDFETFSFLSVEEKEILKRKTYLRTGNTNIEPKAIIDSINTLNQLFMSRMPQFSSSNPDWKLELLPLFAQAANLHLLFLRDVINNATEWELTSTQLTTYKTRLKSKVVEYSNYCLETYRENFNKIYNTLSLKKVLNFRNYMVFNVLDYVSTWSLLRYSNVNINSSTNIYHLEKDITKYASWSIVNQFIQGKPFKIFSGLSSKATSVTFRGSNQINLPAHHMNLIDNVTTHYKGGTSIGPYGALPTANPGNDISYGFKNYSQSTSLSNPIDNPFYKVVQEIQITKPSSKRIETKEYAMYQAVNNPTGQLTDIYGGNWVSFPEYTVKHVMELPVDNDFSLLPAVKSNISLLNHHPLPPYKYSRPGGLIAIFNRDTPIKPYTNTGNFTFKHTVPSDGAGFTISPLQFHSLTANYQPNIDRACIQELLGNHGDGVLFPETKATYTRYNYAIYNPTSTARQYRIYLKLATPNGAAKFWLVFNNGGSVRYDVDTLNQNDGINDHGAAFHEAHYNTIIIPAGETYVLGVEHQGPASILGRIMLTPTNVTPIY

SEQ ID NO: 93 - protein, 187 aa, Bacillus sp.
VNEYIMTNHSNSSGYSDDGVITSNHTMTDNYSGDSLTPNNKIPFSFFVQLPNEFVYHTKQQTKVVYNVKYLTLSQEMVKHPIQVNQLGNIDIDLQVLKVKGCLPIYFNIPITPIAPEHMCTIHREFPLLYMGYQDIISVNHIIKCSTGTLPYYLLDCEHIRICDLQVKAGENEQSVKVSGEFELLYT

SEQ ID NO: 94 - protein, 395 aa, Bacillus sp.
VYQVKEIRFKIGYNSFSFCIEERYMMSNENNNRRNMNASMGSDGESIQNKIGDSRSQISFPDFNFYKIRTFSGKYADITGDSLLVQYNGHNGDNQKFLIVTLDNDYSIIAAKHTGKVMHEFYLFGTGRFLQADFHNMDEQKFFISDDGTIAVKKDRKVWDATGGTSNGSPIIPYDYHGASNQKFTLERSGSVSVTKPTIGTLPPAPDFKTTDLNEILPDNTEPVITHATYLPYFMVKDPYYNNQQKMQNSPYYILVRRQYWEKITQRIVGAGESYKYEQKTGVSRTDQTSMTETTEIAIGADMGFMFKGFSVGLSTSITKTLSVTKSTSTTESTETTEIVTDSNPFMHTIARAKYMLINEYYVTRANGEKITSGDAAYWKVPNPSQTATRTIPRT

SEQ ID NO: 95 - protein, 246 aa, Bacillus sp.
MNQSLTNLKKIKFGPIFKKASLLDENQPIIGIDIEEEIDPKYTPQGMGIMKSFSDYYEIWQDVERNNAEIVIFDEAKAFANLSSFPGKGTAGYHGYNIWKDSKEIVVNDIINLIVEQLIINARIGLLSLNETDKDNLKKLVSRVFTEVGTKDYKRSWSVYNNFSDNSVVYSYSMGLLKQNLTTKPYIYAMPLGFQIRVNKNMKQLFGWNLNSKAAYDVKVVSMVYRETINPNLSQMSFEEYLEILF

SEQ ID NO: 96 - protein, 241 aa, Bacillus sp.
VRNYTSEKQSQTVLFSEKSIETFSRSTTEGYKVGSSIKSTTSFKVKVGFLVSGEISESIEVAVTGEYNHSSTETTTTTTTTTEKLWQVTQPVIIPPHTQITATLQIFSGPFVVPAKTKATIQGKGTINGTPNWASFINYTKYDGRYWAAYNRASGLYNDRNSWPGYKKIYVGTGSGTGSLRLEGEARINAQVGLYAVTEFKESPLPGYESVGSNRTYYAPNIILGDGSIIQFPEYQRYLQR

SEQ ID NO: 97 - protein, 553 aa, Bacillus sp.
MNYKNRTNAKRKYKQTLFVTIATMTLGGSILGNTTSAFSAENTAEKQKVSSYLKNSDTVGSNVFKVAADGSVTLLNSNPFDSPTVKAITLLGGNLLNQAYLDAYKKDFTGTARTLVLGATALIPYVGSFISPVIGLLWPANIGTDMTAQTKALVALINEQIADYDIETLEQKGKTLKDLMSRFDDLLNGKPLTFGEQGTIQETLRNKASNINDKFIEVINDCQKRSFKAEELPIYTLIATAHLLFLNMIEQNGQSSRIQMDDETYKGYVEDFKRLPIEYANYIEATSKLGKQKFNTKMNDTINAAKKQALVGIISSDEKTNLENLEKTRKQCLDEAKLLQQMGDAYGAEKARQKAQKAYEYKKQYEDLIQKRDNYIKNTADNEAFKLAKTSMEELMIDVMIPNGKYIIQSVQNSNMVVGMSGNNIQLEDNNGQLNNKFVIIYDQARNSYVIETSVETGLSSYMAANIDYSNVNKSGVNVYAIPSISSHEQPDILHWKLKRARGSKFVYLENTANGQVLDVSNAGTEKGTNIITWPLKQQGQNQNQGFKLVPTN

SEQ ID NO: 98 - protein, 287 aa, Bacillus sp.
MNHLAFSPRELGGKDSPFLLTIEEWRSFANYLNKWISAPTSIDQVKERIYLILDGKVKSNWDRFITTSTFRRLVEEALATKLNVREKCRFWNNGGHKDILILSQNIVGFADLITIKYFNDLNQVILEAQNGKLSPSTKSKFVNMCKDLSNHAQTFYQQSQSIATSLSEFYSEIQKYEEIVPTWSYLMSQLPLYNSNDFVVAQNTVVYLVAPVKHLIQFKENVLPVIRKVHRIWGSISYDLKELADNIEDIENLEEFIAALELELAFEDWKAIRDEAENFYKNAENFS

SEQ ID NO: 99 - protein, 1261 aa, Bacillus sp.
MNQDYNNKKSEMMDTDVINYQTRYPLAKEPGRIFQEENNKDCNVMYNRNPGTFGPVNTAGKVASGIIGSVMRSFKRQKQIDQIVDIVLIEVYATLWPILEGMWYAMMDAVEIMIQEAITTAVRSKAQAELDGVRNALALYQQAFDDWEKDPDNLQLQERIRRQFTTTNTIIEFAMPSFAVSGFEVPLLVVYAQAANLHLLFLRAAVVFGEKWGMSREEIEDYYSGNFGLTGRTKLYTNHCINWYDKGIEKAKVLNPSATILEQWNLFNDFRREMTIMVLDIVALWPMYDVKLYPEGITTELTRTIYTPSMGILEDSPMMSMVREDHGNLEAMAAQELLSTSPPSLFTWLEKQIVYRYKNAIYGYQNFLRTTFGEEFSSGIIGATDSPYTSNPKSIPIGSELYDVYKVVTSYLEVDPYPNKDSPIHRLVYYRLKDEQESIIRTDTSEGPIDQVSEITYDEEFPENRHRLAYMSGLQSFFSLAWTTEGLFNSYWAPYNITLGWTYADVDRTNTIAPDVITQIPAVKGYKISGNPYLEGAEGIGAVPGPGFTGGNLVGLAAGAKLYMKVTNPVSNLVGYHIRIRYANNQPTVLSISYQGLETSSGRFDIPVTYSGDYTAKLTYEAFHYKETIVISSPIGEEVAEIMLHNEGRSHLLIDKIEFIPIEGSLEEYKVNQALEKARKAVNVLFTSDAKNALKLNITDYVVDQAANLVECVSEDFHAKEKMILLDQVKFAKRLSQARNLLNYGDFESSDWSGENGWRTSNHVHVAVDNPTFKGRYLHMPGAMSPQFSNNIYPTYVYQKVDESKLKSYTRYLVRGFVGNSKDLELLVERYGKDVHVEMNVPNDIRYSLSMNECGGFDRCKPVSYETSPSHTCTCKDIAVAHTDCQCKDKGNRISTNMYTNVPTDSAVYTNGSHAHKSCGCKHTNSSYPNGKHPHKPCGCQNPHVFTYYIDTGCVDQEENLGLFFALKIASENGIANIDNLEIIEAQPLTGEALARVKKREQKWKQERDKKRLETEKAVQAAQEAIQGLFTNTQQNRLKFKTLFPQILKAEMLVQQIPYVYHDYLLGAIPPMLGMNYEIYQQLAASIRNAHTLYAEWNLVSNGTFRSGTGSWNVSEGVKVQPLQNTSVLVLSEWSHEASQQLRIDPDRGYVLRVTARKEGAGKGTVTMSDCAAYTETLTFTSCDYNTVDSQAMTGDTLSGFVTKTLEIFPDTDRIRIDIGETEGTFKVESVELICMEHMVDPICWPDYDCPFPIEPPSVND

SEQ ID NO: 100 - protein, 662 aa, Artificial Sequence
  Synthetic variant of native sequence
MNQDYNNKKSEMMDTDVINYQTRYPLAKEPGRIFQEENNKDCNVMYNRNPGTFGPVNTAGKVASGIIGSVMRSFKRQKQIDQIVDIVLIEVYATLWPILEGMWYAMMDAVEIMIQEAITTAVRSKAQAELDGVRNALALYQQAFDDWEKDPDNLQLQERIRRQFTTTNTIIEFAMPSFAVSGFEVPLLVVYAQAANLHLLFLRAAVVFGEKWGMSREEIEDYYSGNFGLTGRTKLYTNHCINWYDKGIEKAKVLNPSATILEQWNLFNDFRREMTIMVLDIVALWPMYDVKLYPEGITTELTRTIYTPSMGILEDSPMMSMVREDHGNLEAMAAQELLSTSPPSLFTWLEKQIVYRYKNAIYGYQNFLRTTFGEEFSSGIIGATDSPYTSNPKSIPIGSELYDVYKVVTSYLEVDPYPNKDSPIHRLVYYRLKDEQESIIRTDTSEGPIDQVSEITYDEEFPENRHRLAYMSGLQSFFSLAWTTEGLFNSYWAPYNITLGWTYADVDRTNTIAPDVITQIPAVKGYKISGNPYLEGAEGIGAVPGPGFTGGNLVGLAAGAKLYMKVTNPVSNLVGYHIRIRYANNQPTVLSISYQGLETSSGRFDIPVTYSGDYTAKLTYEAFHYKETIVISSPIGEEVAEIMLHNEGRSHLLIDKIEFIPI

SEQ ID NO: 101 - protein, 328 aa, Bacillus sp.
MRKYKKLAVAMPLAGMIMSGVGVLGGPASTFADTMPQAKVAPHVTNFAAADHYQQFMDFMSSKGMERYANNFEIVAMPDSGPKNIRITEAKPINAPENTTQVMSYHNSTGVQQSLKTPSKKITHKNTIAIKNGGSIKTTIESKTTFGVQVPFFAKGEQELKVGLEVTYNRESTDTAENIQEFTVPEQTLLAQPGGTTRLIYTVKSTAFSGTYTNKAIFKQKQDGISKKFENGKEIEGKELESWNETQGYRFIKQIIASQPQLADIFEMDDANEKAYLKEAVFTFEGQAGHQSTAEAVFIPDDNKKSEVKMPIAEYNKRVANGISLYAK

SEQ ID NO: 102 - protein, 299 aa, Bacillus sp.
LQRKSYLLGGETMIHDLKEDILNFTKWYAEKHYNANPDTFHDEKVFNPSVSNTEVVPDKIEFDTTPKLTARATDILINDTSVSQSITPKISTKTVETTSITTTEGYKIGAGIKYTSTMKLKLFLIGEISNSIEIAVTSEYNHSTSETQTNTTEKIWEYTRPVIVPPRTKVTATLEVYAGPVKVPVTLRSTITGMGIASTGYGYILGSVAYKDRDGKNWVDSWRSRSLYDFKSTWPGFKPVYVGTDGEYGVKVQGTAQVELELGLYGVVTYQEEPLLGNDSNKSQTYREIMSRQGLYTRI

SEQ ID NO: 103 - protein, 337 aa, Lysinibacillus sp.
LEGESDMRSKTLRNALIIGMVFITLGGTTTIKPSQTYAESNSMQEKTIGITNVNQVLEKIGNYYYQRNLSLTWYEAPNSIGVKHNFQLRKNSDSISSEIDLSISGEEIESLYYDSTIPKFLGENVFENNTDQEQSYNTSKFSETYTESTSTSVSKGFKINVGRDFTIPLILNEGGKINLEYNSGSTNTNTLSKTYTLEVPSQPVKVPPNKIYKSVVEYSQRTYKGTVKFYGRNLHNPHPINTIKTTGSYTGWMGMQEIKQFTFNDPLYKHYDGLSDSQKKEVENDGVVIIPFLGATYVVVEGKGSFEGVYGAKLNVKTYDITDKNNIKLVDSRSIDL

SEQ ID NO: 104 - protein, 441 aa, Bacillus sp.
LYAHKQPFFFSFLNVQSSAGDYHYSEFQRYSAQYADHCELVVNNQLNKIQNTTGKTWKDYNEYRRKMILSVFDIVAEFSTFDPILYKGAINREILTRKIYTDPVNFTPGSSIANDENKYTVPPSRVNQLVASTLFTNVASAQYAGFIGNINRYLSLSRGEPFDGPLIGNQVYEKVLAGVPTNQSIYEVGVEGIQNDYPRNIGLRWGSLTAFQNFYAGGTTNLGSLTRVSVPPKNNDPINITNFTHQLSDIILPGNSGSSFAWTHVEVNPTGNYLSTNQINLIAGTKASESPQIKKGPRFIGGDLLTADWRTGNIISPSYQLSPKFPGTRTSFRVRVRYGANSSGSMQFTFGATTSSQLAYTATGYSPTNTKYNQFRTIEFFTPLEITTEGKLILVLYNTNSAPTFVIDRLELIPMIGLPTEYNEPQKLETAKKAVTDLFTN

SEQ ID NO: 105 - protein, 415 aa, Artificial Sequence
  Synthetic variant of native sequence
LYAHKQPFFFSFLNVQSSAGDYHYSEFQRYSAQYADHCELVVNNQLNKIQNTTGKTWKDYNEYRRKMILSVFDIVAEFSTFDPILYKGAINREILTRKIYTDPVNFTPGSSIANDENKYTVPPSRVNQLVASTLFTNVASAQYAGFIGNINRYLSLSRGEPFDGPLIGNQVYEKVLAGVPTNQSIYEVGVEGIQNDYPRNIGLRWGSLTAFQNFYAGGTTNLGSLTRVSVPPKNNDPINITNFTHQLSDIILPGNSGSSFAWTHVEVNPTGNYLSTNQINLIAGTKASESPQIKKGPRFIGGDLLTADWRTGNIISPSYQLSPKFPGTRTSFRVRVRYGANSSGSMQFTFGATTSSQLAYTATGYSPTNTKYNQFRTIEFFTPLEITTEGKLILVLYNTNSAPTFVIDRLELIPM

SEQ ID NO: 106 - protein, 565 aa, Bacillus sp.
VNHMYINTMKNTLKIETTDYEIDQAAISIECVSNEQNSQEKMILWDEIKQAKQLSQSRNLLYNGDFEDASNGWKTSYTIEIRKNSPIFKGQYLHMFGARDVLGEVFPTYVYQKIDESKLKPYTRYRVRGFVGSSKDLKLVVTRYGKEIDAIMDVPDDLAYMQPNPSCGDYRCDSSSQSMMSQGYPTPVTDGYASVMYACPSDRVKKHVKCHDRHPFDFHIDTGKLDTNTNLGMLVLFKISHPNGYATLGNLEVIEEGPLTDEALEHVKQKEKKWNRHIEKARMETQQAYDPAKQAVDALFTSVQELHYHTTLNHIKNADQLVQSIPYVNHAWLPDAPSMNYDLYQGLNARIMQAYNLYDARNVITNGDFTQGLHGWHTTGNAAVQQMDGASVLVLSNWSAGVSQNLHAQDHHGYVLRVIAKKEGTGKGYVTMMDCNGKQETLTFTSCEEGYMTKTVEVFPESDRVRIEIGETEGTFYIDSIELLCMKGYTSNYNQNTGNMYEQSYNGNYNQNTSDVYHQGYTNNYNKDSSSMYNQNYTNNDDQHSGCTCNQGHNPGCTCNQRYNR

SEQ ID NO: 107 - protein, 316 aa, Streptomyces sp.
VAGGGRGARPGGGVHRHRARPHREQHPGPPRRGEEGPEAAQGAAGREAGEVREAGRRLPDRRQARGVPQGRPGLRPQREAAPRPRLNRPHGGRRAPGRGRLGILTPPDHRIDHRIDHRDHPGGALAASFRTVVEVAQDHLAQARSIDRVFQEAIAPATVNFDFEAIHRAASAVPDSDVVKMVRGWGLQEHAPVLVMVLSLKEAVRQALPPECAEAGFWATVERELVQAFTGLAAQEGRPGLSFYEESGDRTRFYRDLFFALQDEETGDHMYALAFCVDVTVELPKAETLALDLTDVVSFAVRLNAIVVRQALAVSV

SEQ ID NO: 108 - protein, 336 aa, Bacillus sp.
MLIVCYLRSYIFNGGNKMTNTQMDNKYLFRPSYEAKPDGTTVNPYYIIINDLKRWPCYVTDNRNFISSSEELQTRVAPSYDPTGKYDGTPSADFNRVYRDYALDPAFRPLYAINAQILPKYNYWHQGNWQYNELGRVSQLGQDIQNFANLICVKYINELNQIIDDTQNDKLSQKDIDTFKNICSDLQSQIGPCQRRSRNIYNEYQNAINILLSQSHHDAANYAFTIVDNAYSTAKSGDQNALGGIRSYASSVLNYANAYDQGVITASMNLQGMWMFFGDNLQELISNLKDPIVDHNALIASLQLEIAIEEWQNVSTNAAEFIKEWAGYGASLGYDC

SEQ ID NO: 109 - protein, 307 aa, Bacillus sp.
LSIYNYRITSWFGDRSILPSNETLQQQSWTGEAKQKWNLRDLGDYSFEIVNQANGKVPTYQWAGSLVDNVEYLKLDYSNPSDPDKVFGIINRSFLFDGTNYAIHAEDLVKIQKLPDVGTRPDAPNYTGGVDQQLPQVSDSVVVGASLIPCIMVNDNQASDYTKIHNSPYYTLVKEEYWDKTYSAVIPAGVTHKYSFTTGMSSVDQQKMTDTLSMSIGADFGLSFGAASASLKTEISRTIQTEISSTNTNASEENVTRDVQSEPGKTTGFTEYQLATRYTLKRADGSIVSDPWVVKNNKITITRKNAQ

SEQ ID NO: 110 - protein, 328 aa, Lysinibacillus sp.
MRKNKKIVQKTLTIAAIASLGTTLAISSPSLASADQINTSENNLQREVKAHTILDWKDPIFNATEIVGKNLLVPGIYLFTNSTYHHMGYYGVKYEQFSVEADGSPSHTNSTSIFVGKTTLTNITDQEQTLSTNSFSKMISNSVSNSTTHGFKFGTKASAKFQIPFVGETGIELSAEYNFSDTSSTTNTESYTYIASPQNIKVPAHSTVEVLVNLNTVKAKGNVKLLTKVSGRDQGVFVFDPQTGDISKSYYYDLHFNQIVEKASKFEKLHNISSNSDGNTVNIIGSGKYEAEYGTEFSVTVRPVDNKGRSINGGYTFNVKPEKIIKVE

SEQ ID NO: 111 - protein, 338 aa, Paenibacillus sp.
MRKHVLKHGLVIGLSALMLGSASAPPQVYAEASIAQEKSIGIVDVNEVLKKVGTYYYKNHLANTVANPESNGFRYTLRANPDSVTPVIDLSIEARTENIHYDSTIPIFIGENTFPNNLDEEQSYNTLKYSKTYTESTSTSISSGFKVGGAGDLGNKFILPLILEGAGKINLEYNTGSTETNTTSESYTLEVPPQPVKVPPHKTYKTVVEFSQRTYRGDVVFTGRTESTMANRSIINATGIYTGWMGMQDSKKFTYDNYLGVHYAGLTASQQQEIKNAGVQITTSGYGAAANRFSSIEVTGKGSFSGVIGAELIVTTYDVTDAKNARLVNQRTVPIELD

SEQ ID NO: 112 - protein, 684 aa, Bacillus sp.
MDALIYVDYIYIDTISIIDIENIYVKNGGSLMKRNKDCNDGIQKSDMSDRYPYANDPNAALQNMEYKEWLSVCQEGGQQVLHLESVGNETVNAVSAGVIVVGTMMSAMSAPLAIPGGILISFGTLAAALWPDEENPTKVWSDFMKHGETLFDKKISELVKKQAQAHFEGIKTLLVDYEKAFNDWKENKNRLTAEKVKREFNDVDRQIKTVIPHLKYEGYEALLLSCFAQVANLHLNLLHQGAAFGDEWDKYSSYLSTSEDCYEDLMSRIETYINHCTKTYNDGLIELKNKPNIKWNIYNTYRREMTLTALDLVALFPNYDVKKYPIGTQTELTREVYTVLNSMDDLVDFEAAEKSLIQNPHVFRWLAGFTFVTKNISAIDLKYLSGIRNWYYYTNFDTLKADKANSENSGGGSQKFFFGAGSIYKLEIIRNMDDHWGGLPFANEVQVFTPSITYDNKQSQTNSVYNKKGDASSGIPIMDLLYLPKAKDDSPFSQQDIPSANNYSHRLSYIARVKKIRGTRDVYNYAFAWTHRSVNRHNTIAKDVITQIPAVKALEPNKDFDVIKGPGHTGGDLVKLNYNETSGLEIKCLTENHPKIDYRIRIRYAANEDTRVEIIVPESDGFGSIKPAKKTYSDDNYQKYNSFQYLDTRAVVYGEGKQVALSIKNLEPDTFILIDKIEFIPWFG

SEQ ID NO: 113 - protein, 682 aa, Artificial Sequence
  Synthetic variant of native sequence
MDALIYVDYIYIDTISIIDIENIYVKNGGSLMKRNKDCNDGIQKSDMSDRYPYANDPNAALQNMEYKEWLSVCQEGGQQVLHLESVGNETVNAVSAGVIVVGTMMSAMSAPLAIPGGILISFGTLAAALWPDEENPTKVWSDFMKHGETLFDKKISELVKKQAQAHFEGIKTLLVDYEKAFNDWKENKNRLTAEKVKREFNDVDRQIKTVIPHLKYEGYEALLLSCFAQVANLHLNLLHQGAAFGDEWDKYSSYLSTSEDCYEDLMSRIETYINHCTKTYNDGLIELKNKPNIKWNIYNTYRREMTLTALDLVALFPNYDVKKYPIGTQTELTREVYTVLNSMDDLVDFEAAEKSLIQNPHVFRWLAGFTFVTKNISAIDLKYLSGIRNWYYYTNFDTLKADKANSENSGGGSQKFFFGAGSIYKLEIIRNMDDHWGGLPFANEVQVFTPSITYDNKQSQTNSVYNKKGDASSGIPIMDLLYLPKAKDDSPFSQQDIPSANNYSHRLSYIARVKKIRGTRDVYNYAFAWTHRSVNRHNTIAKDVITQIPAVKALEPNKDFDVIKGPGHTGGDLVKLNYNETSGLEIKCLTENHPKIDYRIRIRYAANEDTRVEIIVPESDGFGSIKPAKKTYSDDNYQKYNSFQYLDTRAVVYGEGKQVALSIKNLEPDTFILIDKIEFIPW

SEQ ID NO: 114 - protein, 311 aa, Bacillus sp.
MVIFDIDQYLYNLDLALTHTMVAHSTGDLEHCKANNYYYDEVYYNEVNINPLHYNNSRVILSNQKLDYNLPPLSSENVSPLVVSGGTFKNNTNDVQTYTSLEITRKQGTSQKSSITYGFKAGTKLSASYKLKGGISLIAGGETSFNFEFSFEANFSKTDETVETDETTVRVPPQTIIVKPGETKRLEVTLYRIVIPDTKFDIDGDISGKIQYGSGNPYVDIYETFDYVQKHCPGTYVNRSGDDLIRLNSSKKTLRFKGFGKVAFEYEMNMITIDNKTGKVVHEERVPVDGYHPISYKFQDGQKPVPMQIFG

SEQ ID NO: 115 - protein, 296 aa, Bacillus sp.
MKINKLKEEPQNFYTLIAKELKLVSSCYFAYIYPYHHVTDNKTLANLLYPPYTDRGVINFDFFRKHRQFVHFFHIYEMDDVFHSLMNIHAGIYNSDLWWKLLGDQKVNLLSQDIESFADIICVEHIDELNEIIKNADNNKLSEKNIDTLKKIYDELNKNIGNYNQKAEEILNQCNQLLQFIVSYSGKINDTISKIKSIYMISKPTDKNYFEDLLLFLKKEKIVIDRYNPEIITILMNLQAIWRVFASSLQDLIQEWENPLIDDNTLVFSLELKAAIATYEQIKQGIETFRIKWKDD

SEQ ID NO: 116 - protein, 326 aa, Brevibacillus sp.
MKKKMNKNRLKKPMVAIMLATSIGIPCISASGSALATENTPTSVNENVKVGVTDVQSELKKIGEYHYTNNIAGTKIESWPTLTFGSRPDSVETKVNFSITGTENKLNFDSKIVEYVGENIFENTTEQSQKFSTAKYTKSVTESIATATTKGFKVGGSGDGSNIFTIPLLLNNGIKINGEFNSSTTETKTKSETRSIEASAQSIEVPPHKKYKADVVLEQRNFWGDVTFTGVGVKPATTIKGTASYWAPNGMGAWKQYTFSDNTVNYWKGLTASQKNSINGIKFENNDVKAEGTAKVEGTFGSMLIVKVYDITDKSNPKLVETRSFK

SEQ ID NO: 117 - protein, 630 aa, Bacillus sp.
MNKNSNNNEFTNNNGMVSQPKHPFVKEPGSELQNMNTVGAPIALSSTTTRDGVIIATGIGWAILGFVPVVGPGLSAAAGLLNVIVPFLWPEDDAGSSQISWEQLMDSVEELVDERILTSKRSDATARLEGIKALVNEYTQAIDDLKADPNNELKKDRVRDKFDDVEDYVKVSMPFFRAQGFEVPMLAMYAQAANIHLLLLRDVVQHGASWGFQQYEIDRYYNHTGLTGSPGMLQLLAQYTAHCVRWYNTGLENRRATNDWNKFNDFRRDMTLMVLDIISLWPTYDPKFYAVPTKSQLTRTVYTHWIGHLRNRWHGNPDALSLSVVENSIVPAPHLFTWLREVWFYFTGGGGPSAETLFTGFRPFFQTTLSDNLLTGELQGNYGTEPRQDITIPSPQSGDDIWKVHTSSALMAEGPEHRRLKGWWFLFTNSPTQQAHTKTGYGQQLIYTHLGLPCKNSCGDENPNLSNPCDNSSLYSHRLSNFRGNFDPTYCSYGWTHVSADHNNLIDAQKITQIPAVKASSISGGARVVKGPGSTGGDLVELDFSTASSLRLKVTLADTTKSYQIRTRSAYGSVSKSADTLTYSDFSYANSTIIPPRDSSEYTYIMELDPSDFGGLEGKFFIDKIEFIPM

SEQ ID NO: 118 - protein, 373 aa, Bacillus sp.
VGKSMTFKVGMKYMFKNKNSRKYLDIEGNQTGNNANVQQYEYLADALSERFFLHKLDDNYYAIINLNSGKVIDIRGNQTGNNANIQQFEWRGDANSEYWYFRREEDGYYVIESKHSGKVIDIEGNQTGNNANVQQFQFLKDAPSERFAVEEAGSVSLPSINTQPLSPVPQYETINDQLPEETERVVTAFTIVPAIAVKDPHYGGDTAKQIKENPYYMVVKKQWWKKQESYVLAPGETYNFEVTTGIRVTDQETATKTVSLSIGADMGFSFKGVSLGMSSQYSQELQTSISHTTEQLKEETKRHTITNLFSERMAYSRYILTTEYSVRRDSGTIVNSSWTMTDKTRTHAVTFPKSTGKVLNENIKQISKSESLK

SEQ ID NO: 119 - protein, 503 aa, Bacillus sp.
LMKYKDRKHAKRKYKQALLATVATLTLGVSTLESTASAFAEEKDKNAPQQQNTIQQKDAGTYYEGEQKELNPLAQLDKWTQDLGKTSGAGDYKTTLGMVEKLLPTIYKDLNSGNFNNTARSFTMLSTALIPYGGAFISPIVGLIWPENTTAQDAKLQKMVEGLTSMMGQKINDYDLAKLKQKTDALTNTLKKFQDSVNNKPQSESYYDNIQTANVTYADYINTKFEEIIKESQTPGHQIPELPIFTVIATAHLQFLHFIEENAVKNPRIKMDPEHLNRYFPKFKDTARKYRKYINDVNHDAQQWLYDFTGGGHIKANNPAHIEAMNKIADLTKQTSDNEAFLLASNPPSVGDKTGLVKEDGDKWHYYSPRDGFENSQHQKFNKGSLVTGPLDIDGRTYLFSFEEGMKNSAGKKFNKGDMFTGWYNDAGVWSYYKPESGVMATDWQNISGKWYYFATAYQEFNGGAFISKGDMIKGKTVEISGKLYTFDENGACLNPDGKPIAK

SEQ ID NO: 120 - protein, 722 aa, Bacillus sp.
MYLIMYNNEEQPIANRKSNPNVENDCRCSEDNYNLLQEEPTLSQVSIADTKNLYTSLLLAENGGELQPKVPDFPTYVTTPNNEDSKICVKDITCVWGKWGENRQGFLEPAVRITPVAGAIGSFLLQKIGGLIATKLINGLYGILFPTPHPITLEQILEAVSELLNQRLDTENYNRVSLELEGLQNSSKAFIETVEAYEQKIYTDPLYAETHADEIRNAMNTFHTLCVNRMPQFRLPGYQILLLPLYAQAANIHIGFLKDVLDNQTKWGLSAADVKLYTNRFLDVIGIYSTYCNTTYHTDFIKQFSDDFKRPLDYRTFMILNVLDYVSLWSMLRFNKLEVLTSAPLYEYGRATPNGIIPKYSYSFWDNLNRLFQGFPNRVLDRVVSQNKLIFSNRPPTLYNYLNRSYSITTYYSGNKSFKVGYNTYSFCNGNDRCEYYTSSINAKNLKEASQISNLYTYSQGWPNVRLEVRDWHDMRYRDGDRVEATIASDPYSYNWVSYPERTIQSIIGLPPSMLNEHINIIDGPQNRVQSDGVIAANITSFQRKAAKTYAVSNGTIRHPFTAGKGLAISPLEFYDTYNVGSNATKKREFYIVQRYGNNGDAVRIPSPKSFGSNFHGLIYHIFNPYDVSFSLDVYLKVSAPNRTSVGVYLNGVGATKEIYTATDNDGVTDNDSESKIVKFLSGFNLKPGNVELYIENSGSADLFVENIIVVPAGSTFISRIN

SEQ ID NO: 121 - protein, 1888 aa, Bacillus sp.
MLNYISLERGGFMASLADLYPSYYNVLAEPPFINGDNDIIITAKSDCKEDSASEAAGNSNKNNYWAGAQSTWKCYWQSGYQDAYTGVISAAFSDDNFNYVDFTKKVIGLNGFFISWLGGEISEELRSTLNGAEKALEVAGMVTLPIVVPIAQALVMAIFPISVTKKKREDQAKTLWDLLAKRVDEEIKDLIKDYDANALNQFIAGFQTVLKDLSDAVQIAICQPIDLNPDIPSKVNPNCIPYTDIELVNNVKQKLSTVDSAFTTLIPQFQKSDYASAELPQFCLAATLHLSTLHSAIIMSEPWELNPNIRKSYIRKLRRLIKSYSLYVTQVVTKASQDYLKQNSAGNLTKKGFNEYNQLLSFYVTECLDYVAMWRFLDPIDYPLPTYAELTRVIVGNIVGPYEEDNTVGGNATPISDDLRPKIQIFDPTSQDFKELSNSRMYDLLGLTYNNLQMKNVTMHSQGDSRNVVVAGEHLEYMYYQDSLTKDFGNTTGHSVFSDVSLNPATYLNMESAYNNVNNVDQTELHICKMNGDIDIVGAVDFETCNAHGGKGLGTRCTSNNKPLGIDKIQMIYPVTVESIAGNQAKMGFVATHVHDIVTPENIIGQKMQDNDGNDTDQPLLQIRTISVEKGKLSGNARPIKEYVTGSNPVLIPPGGSIDLTCTNLTAQKYFIRFCLSTMSDALSLQWQLNNGQTQVVSIPTATSNFISNDQKGISGLSLNFGPYTADNLYAVFPETTFDDNGLPILPDESHAVEIGDGEFTVTITNPAPSVSNDSNDITVDRIEFIPYIEQPAPELQKYLMDTLSNIQPFTVGLNQPTIIWSSTDRVATELDMRYEGYHPSFINSNPRLDFYYNNVLQTAIRSETPDIYGYYNYTIEGNDTDKTGGFDRVELIANTTNLETITLSGKVYGPNQQYKPTPPPTPPTPPTPAATIVDSVPFVVGKGANKTIWSSTSIVANQANLKLVAYQPDFITYDYQFAFYYNGVLQNSIQTRDPKGFDMYAVSSGFNSIALISKAPNFETVRLSGNIYTPQTPPPPPPPTPLPAATIVDSVPFVVGKGADTTIWRSTSIVANQANLKLVAYQPDFLTSEHQFAFYYNDVLQKVTLTGQDSKGFDIYSVSSGFNSIALISQVPNFETVRLSGDIYAPQITPKPPTLPESVGGFSTPKSLDIPVNTSSEVWRDYTVYGIQAKINTRFLDSPDRNITYWYQFYLTSGEGQNDTLVHEEKAKSGDYEYIVNHYFNKIVLHVTGFYPVSEPSTSSVTIESCAIYGYERQKIDPSVNKTIEPMDTFGRKSIEIWTPTKPTAKGFEAILGVDVITMGAWSSDTVYQFYLNGQLVTEQPVDFTNLMKNVYEVPQGFNSISIFDPNAYDPDDPDDNGNYPLTGDEYNITIIGTIFGDASSSNLPPENPVDGTMFTTREAFMTIARLVYALFTTSSQTTLNLTITDYWIHQLVMKVNKLSNEKFGIEKKELLKLLSKAKQILKGKNFLRNGSFDTLDNWQVGREVAAIYGHELFQGNYLFLPPPTLAPSYAYQRIPESRLKKNTRYKISGFIASSLELELIVSRYGKEIVKTLNVPYGKALPVSPDAHPNCCNHNLCGCPSCIGNGTNKHFFNYCIDVGTVQTITDLGIEFGVRIKKGNGYAKLGYLEIQEERPLTPQEVQNVQQKELKWKETFLQEKQQITNLLNPIITKINAFFKNKDWNSDILPHVTYQDLSTIIIPKLPKMTHWFMTDRVGEHYEIMQKLQQALQRVRTHLDAENLIHNGDFTDGLQNWEIQGDVSLFAPGILQLSDWDASVSQTIEILNFTAGQGYTLLVNSKGAGSITIEHGQVVETLHMMSPNFMTKTLTFYPVSPTLEIQILSDGAELLVDSVTILQNPIENSDATSCE

SEQ ID NO: 122 - protein, 788 aa, Artificial Sequence
  Synthetic variant of native sequence
MLNYISLERGGFMASLADLYPSYYNVLAEPPFINGDNDIIITAKSDCKEDSASEAAGNSNKNNYWAGAQSTWKCYWQSGYQDAYTGVISAAFSDDNFNYVDFTKKVIGLNGFFISWLGGEISEELRSTLNGAEKALEVAGMVTLPIVVPIAQALVMAIFPISVTKKKREDQAKTLWDLLAKRVDEEIKDLIKDYDANALNQFIAGFQTVLKDLSDAVQIAICQPIDLNPDIPSKVNPNCIPYTDIELVNNVKQKLSTVDSAFTTLIPQFQKSDYASAELPQFCLAATLHLSTLHSAIIMSEPWELNPNIRKSYIRKLRRLIKSYSLYVTQVVTKASQDYLKQNSAGNLTKKGFNEYNQLLSFYVTECLDYVAMWRFLDPIDYPLPTYAELTRVIVGNIVGPYEEDNTVGGNATPISDDLRPKIQIFDPTSQDFKELSNSRMYDLLGLTYNNLQMKNVTMHSQGDSRNVVVAGEHLEYMYYQDSLTKDFGNTTGHSVFSDVSLNPATYLNMESAYNNVNNVDQTELHICKMNGDIDIVGAVDFETCNAHGGKGLGTRCTSNNKPLGIDKIQMIYPVTVESIAGNQAKMGFVATHVHDIVTPENIIGQKMQDNDGNDTDQPLLQIRTISVEKGKLSGNARPIKEYVTGSNPVLIPPGGSIDLTCTNLTAQKYFIRFCLSTMSDALSLQWQLNNGQTQVVSIPTATSNFISNDQKGISGLSLNFGPYTADNLYAVFPETTFDDNGLPILPDESHAVEIGDGEFTVTITNPAPSVSNDSNDITVDRIEFIPY

SEQ ID NO: 123 - protein, 674 aa, Bacillus sp.
MDSNKQKEMSEITSITNDGNCDDTKGVETLEIAEPLVSYSWTEKNLVEIEDEWKRWSDENEFLSIPPVVGTVSSLILKKIAGMIGDKLLKSLFEKLFPTPNPVTILEILEAVQKLLNERLSQEIHQRITLELEGLQQNITNFLEDVEDFEGRIIVDELEDGNQPLAIIDSIHTLNQIFDNRMPQFRNPDYKVLLLPLYAQAANLHISFLKDVVDNASKWGLTASQIKTYTNRFLDKISQYSNYCIETFQRDFQSKFSQKLQDVLKYRNFMTINVLDYVSLWPMLRFTKPFNFRTSSNLYEMGPTPGENFIFPYSSWANFHIIFQGFPNKELQSISATNRFYRAYKQSGGWSMLAITEVMGNLTCNYSGGKSIKFGYESLPSCPDDTGVQRCDVVKEEINDFSRSQLNQVLLSSSVSTTNPPYMSAKYLQNVKLSNGTVYNLINGEYGSWISYPNYTIRNIIGWAKFMESKATNIIDGPSNQYEGSLRGNLSTNIVSFQRREYDPYTIYNGGKRHTIPSHTRGILISPLEYSGTFNVGTGTKGNFVIHERHGNNGDAVVIPKTNGGYRHGFEYILFNPYGTNLNMDIYIKISAPVKTKLVYLINGAGLNKEIVTSTDNDGVTDNGQKSKIIKLYSNKQLVPGNTTFSIQNGGLGDLYLEGIVVVPNGSSLISRIQ

SEQ ID NO: 124 - protein, 610 aa, Bacillus sp.
LMKYKERKDAKRKYKQALLTTVATMTLGVNTLGNTSSTFAAEEDNISVISTHTINNVGTQTDISEEAKKKTFFSKVSANLTTATGKKIVVAGEKELLNMIKTQKVDFNNASRALVGAIIDNAVPGGMFLSPLINTIWPENGNGEIQQLREELMKVMDEKITTSHMNSLKEEFRALNTIQNKFEKAVNEKNSQNVDASTKRTRSGWASGIEQAYMRLLALTSSNDFKVADLPLYTQIATAHIAFLTSLDTPEMAAKVDITTTGLKEFYNKGELSKLANEYMRHITETYDYAKREYINKIEQVGVAFDPSNEANQQADLNNRLHSAEKKLKDREGVLSTNPAMIWDNDPKYKKNKTEVTYLKDAKDAYPTLLKLYKLTVSDPNMAELSKGTWMEKSGKWHFTNKNGHDMLGWVQDNGKRYYISPENGTKNSAGDTFNKGEMVTGWKEVDGHRYYFSPKKTDTGNNHKPIAEGEMVTDWKEVDGHRYYFSPENGTRGYERPADNEKESPFKEFTKGEMMTGFIQRQSDYNWFFLSPEKNTQNSDGTTFVEGEMMTAWYSNPKDDKHWYYFSTSNQPDDSNSQRLESGQMAKYLNIGGYNFNRYGVCTNPNYKK

SEQ ID NO: 125 - protein, 289 aa, Bacillus sp.
MNYAAFSTHELGGKSSPFLLSVEEWRAFSNYINQCVSLPTNIDSIIDAINRVKNGTLKQSLFDLRNRGSSYTRVLTTSIEMTTKVKEASLFWGAGGRVGIISLAQNIVRYADLICIKHYADLNQVLLEAQKGHLSPNTKSKFINICKDLSEHALRYHLESQTMLTYISGFYTVIGGCKDTHQNCQDTLFRVPMYNNREYEVIAHTDIYLLRSIRNVIPSEAYILPVIRKIHLIWSAISYDLKELGADLNEDLVSLPAIIAALELELAFENWSAIRQEAEDFYKNAENFS

SEQ ID NO: 126 - protein, 407 aa, Bacillus sp.
MQRKVYTKISGCSREASLCPNSPDSIVKKIEIKEVNQMKVNKQGLPAESKKFQKITFKLTHEGHRVLTAAKTKDGEGLKACTKISVDNTVVNEQAKHDFPTQYQIFYPLDNGKFVIANKGTGWVLHSGFEPGTPQTVVTSTPFDSNNISNQSFERKSKDSSGDFRLIDKDGWAVNVCSHAHNEYTKITTVEDNAEKEHLLLKFKTSENAKLPNIPSTTTLEPIPELKGFNDPLPENEDAKRAVIGSALIPCIIVNDHIPLEDRIKQHPYYILEYRQYWHLLWSDVFTAGSNKIKTEVTGIPSEAQEKMKELIGASIRTDIGLRFTDKSEPFGKQITSGLNVKHSYDYELGETTTTTNVDNPNDFTVRYARYARAHEFVLKRSDGQVVEEPWVAVDENDMYLKMYKKA

SEQ ID NO: 127 - protein, 353 aa, Bacillus sp.
MVKRDISPRNLGGKEDSPFLLSKEEWITIQKYTGDGAYVPVNEAEMRKALALSSSDEMPDFNELYSVYTNVKNHCQNWTDNTYREVLGIANEIVNYARRAKVYYKPLIDYLPAIIDGDTEALEMFKKICERLAKEAAEFRDHAGALATMIGIFATDTANDYQSLIVVKDKYDKKYGDHSEEVKQLRDSVDRLRKDLEKYMDEYEDYQSQSWLSLLLGPIWGFVLKGVLDSTKGKALKARIDATKKQIEESGKIIQRNVYLMSLLDKTDTGTDKIQEQMAAALPVIQKIHGIWNSLHSDLDELSKIVMEDIRDDPEFADLGVELAIMQWEAVGKQADDFRVNADVGFVVEQYTA

SEQ ID NO: 128 - protein, 654 aa, Unknown
  organism from environmental sample
VHLVFLILIYTQIFKEEFYMNNVLNSGRTTICDGHNVMAQDPFNFQHKSLDTIQKEWTEWKRDDHSLYVAPVVGTVAVFLLKKVGSFAAKRILNGLWDLVFPNDNTKLMQDILRETEKFLNQRLNADTLSRVNAELEGLQKNVAEFNRQVDNFLNPNRNPTLLSITSSVNTMQQLFLNRLTQFQLRGYELLLLPLFAQAANLHLSFIRDVILNAEEWGISAATLRTYRDYLKDYTKEYSNYCINTYQTAFKKLNTPLHEMLEFRTYMFLNVFEYVSIWSLFKYQSLLVSSGANLYASGSGPQQKQSFSAQNWPFLYSLFQVNSNYVLTGFSGSRSTVKFPGGGGLLPPGSTTTYALHSARANYKEGVSSGIIGGTNFNHNFKCRTILPPLLTPFVRSWLDSGTDREGVTTFTNWQTEAFETTFGIRGGAFGPRGNANYFPDYFIRNISGLPLVVRKEDLTKPLHYNEIKNIESPSGTPGGARAYMVSVHNRKNNIYDAHENGTMIHLAPDDDTGFTISPIHATQVNNQIRTFISEKFGNQGDSLRFEQTNTAARYTFRGNGNNYTLYLRVSSQGNSTIRVNINGRVFNVPNVNTTTNNDGVIDNGARFSDIRIGNIVASNNTNIPLDINVTLNSGTQFELMNIMFVPNNLPPLY

SEQ ID NO: 129 - protein, 648 aa, Artificial Sequence
  Synthetic variant of native sequence
VHLVFLILIYTQIFKEEFYMNNVLNSGRTTICDGHNVMAQDPFNFQHKSLDTIQKEWTEWKRDDHSLYVAPVVGTVAVFLLKKVGSFAAKRILNGLWDLVFPNDNTKLMQDILRETEKFLNQRLNADTLSRVNAELEGLQKNVAEFNRQVDNFLNPNRNPTLLSITSSVNTMQQLFLNRLTQFQLRGYELLLLPLFAQAANLHLSFIRDVILNAEEWGISAATLRTYRDYLKDYTKEYSNYCINTYQTAFKKLNTPLHEMLEFRTYMFLNVFEYVSIWSLFKYQSLLVSSGANLYASGSGPQQKQSFSAQNWPFLYSLFQVNSNYVLTGFSGSRSTVKFPGGGGLLPPGSTTTYALHSARANYKEGVSSGIIGGTNFNHNFKCRTILPPLLTPFVRSWLDSGTDREGVTTFTNWQTEAFETTFGIRGGAFGPRGNANYFPDYFIRNISGLPLVVRKEDLTKPLHYNEIKNIESPSGTPGGARAYMVSVHNRKNNIYDAHENGTMIHLAPDDDTGFTISPIHATQVNNQIRTFISEKFGNQGDSLRFEQTNTAARYTFRGNGNNYTLYLRVSSQGNSTIRVNINGRVFNVPNVNTTTNNDGVIDNGARFSDIRIGNIVASNNTNIPLDINVTLNSGTQFELMNIMFVPN

SEQ ID NO: 130 - protein, 394 aa, Bacillus sp.
MKIIIGGSKMKKMLITGVLLTAVATNYLIPVNAFAAENHLEVQQINSQQERASDTLSLSLRRVGSNSALLQGYGLVILQQSNITLPAMGSLTTHQKIAKTNVKEWLDEHNPKLIALNQDIKKFSTKFNGYYQTLYDLAGQVNENEQEKQNFEKGLSTLKDQGQNTKSTMNDTLSKFKDFKTLLDDDVEKFSTAASDAIQSVQGPGGDAIQLRENIKKLQQDIQTELTNILNRPSEIINGSINFGKKVYTIGMSSAESQTIDLVSIQSLTGDLLDLSDHKIKESANKIDAINNELVLLTKNLSDMLIQVTGITFIEDQVTGFAGMIDRQITTLEFLMKDWDVINEKINQIQSNLDSGANSGLLKDQLVELKKLNDEMENQSKQFEDFLTVEITQI

SEQ ID NO: 131 - protein, 525 aa, Bacillus sp.
LLGVMGELQNILYKRSGKMNTHGKNEEWNQHHDGTCGCQQNKQDYGYEQIPEHDKQQYASHEYKNQEYTYKDSCGEIGTGYHNENNGDFQCDTIRYTTPNLPVESTRFQTITNINTNDNGHRVMDAMNIAVGTGLEQRVGGCPWQIDVENTVVNEQVRFNNQSQLFVFYQTDSGQFVIANRGNGRVLEMVEFPNSDPQWHQLLISSFYENRRNQLFDRRIINNTDFLLTTITETGSVFGVQNCNNNPNAWQIYTTVNENESVGFRNNTYRFRTENNLPINIPPLRSGEPLGPLPALRYLQDSGLSPAEAPRAVIGSALLPAIFVEDVLSLPARMAQSPYYVLEYRQYWHRLWSDIIPANGQSWFNETTGMLGGAPQQGNMRNTISMSIAPDLGIRFGTQSMPFSIKIAEGLGRQRSNANIDIGETSQNIRYDNPQNQPTRFARFALAHEYALLRMDGRVINRWTVVDRSSMYLLSFPQNALLTMQCDKIIRTDNSYDLSVWKTPMQIKSGQVITKNEKNSKPYNA

SEQ ID NO: 132 - protein, 463 aa, Bacillus sp.
VRSGINMDLSHANHDTDNQIYKTSCECNQKTEWPMSKKQEQTHTDTHYKATQFNSPIWNLPIESRRFQTITDVNSSQGRGLNALRTYPGQLLGGDLGAFCRTVTLQNQVVNDLTRGNIARFLFYNLDNGGFVIANANVGEVLQEMNANNSSLITNTYTGQTNQFFRKSPITQDHFRLLTNENMIVGPCGNNASNSWTRITLALFSNQNFRYRHEPSENQPINLPQAAATSELAPLPALTSLNDPGPSPVVAPRVTIGSALIPCIFVNDVIPLQHRIRQSPYYVLECRQYWHRIWSDVLTAGSDAFYEERTGISDGAQIDIRNTMDISIGSDWYLRFGSLSSPFRGQISSGLRTQPSFSNIDLAETVMINRHINPNSFTTRFSRFTKAIEYRLLRMDGTVVRSWVAVDNRSMYWKTFPNNAQSTMQSQKIIQSDTSYDLSVWKTPMVIRDGEIIEKNDHNSKTQ

SEQ ID NO: 133 - protein, 952 aa, Bacillus sp.
MIMQMVTKAMTPKLGALPDFIDDFNGIFGFMDNITGVMSTIFGVDTGDSSIDNVLNNQELLQEMLDQMSTMQSSIQDILEQQGISADIEKQILALTTDLATSINTELGKIEGILNTYLPAISNMLSNIYEQTSLIDQKVDKLLALMTFALKELDYIKDNVVLNSSIVEITPHVQKLVYVNKKFLSLTRGFLQGEDVSIDSMQEIQEWAKSILATEMNSFEFSVDTLHNIIIGDNLYKRSALKTFSDVLLDDADQYGDFGTPLAKFYTFFSSLATLQINAYLCLTFARKVLGLSEIDYQVTMQDRIEQQNQMFVNLIQDKNYSNALEITGIYPMSVDWGDCKSTDLQADAGYALIGLEFFMDNGIYKVKAYQGKIGKNFSVSGDTVTEIISDDLSTVFNDMTNDNPELDVVYPLSGELTGPPNTIITRIGFGTKYDKTRESSVQAFAYIDADFSPYDYISGTISKEGTQTVSLEGNDHKNRCYSMWPIGLIGDLYMTPLKSLSLNVDVDDSSAYGTILNMSGESYFSTILSREYNTNFILFPYTNNSGLIDENLIQNGNLEEQDKYWEGTEPSFFAEGEGTFGSNALKVQAQGAFDQIVKLEPNTTYRLTAFTKVKDSNYSKGRIGIRDMYNYRVEKSFLHTRYKQTKVEFTTGADTSKLSVFIQGGGDQESIAWADNIELYKVHQQDNMISDFDFDTYKYSNMCWKLSGGGDFVEKEGLFNSKALKITNSGGAEQEVKLKANTNYILTAYVKVDVPTTTAQIGCGSNQVPCNSTSYTPVKLKFKTGEDPSTTESSVYCSNSNDSGTVWADNFVLYEAPNLIINGDFEQFDQSSWNFSPSEGGRIYLQSGLGMSRSNAVVLHGQNGQISQKVPLKPFTKYRLTAYVRVSDGGTAWIGYGDYGASCTSKEFKQISKDFTTGANPLQSDDAIYLSSDNSKYTVADNFELYELDQI

SEQ ID NO: 134 - protein, 354 aa, Unknown
  organism from environmental sample
MEIKKDAYYKIVNRNSGLVADVAGKSKGNSAHLEQLDWHGEPFQQWLLYPLDGGRYAIINRNSGLVADVAGKSTSNSARLEQLDWHGEPFQQWLLYQTNDQGYYKIVNQNSGLVADVAGKSKGNSAHLEQLDDQNESFQYWSFDEVESITLPSVETKPLPIAPQYKSLNDYLPDSTEPVVTAYTLLPCIMVNDNNWSADKKMQHSPYYMLTKTQYWKKIDSHTFAPHAQYTSETKYGMSQTDQESMTRNTNISVKADAGFSFKAVSIGISKSVTKELQVSKSTTTTQMTEQTNSETIANPNNYTVAWTKYALVTEYTLKRGDGIRVSDPWTVINKNDERESYWPLDAPLNKAQI

SEQ ID NO: 135 - protein, 375 aa, Bacillus sp.
MMKKIPYKIIVASALLTMTTTSVVSPVAAFASEIEQPSTGDMSLSANEVKMKEALQKAGLFAKSMNEYSYLLINNPDVNFEGITINGYADLPNKIVQDQRNARAHAVTWNTQVKRQLLDTLTGIVEYDTMFDNYYDTIIDAINTGDGDTLKEGITDLRSEIQQNQKTAQNLIAELTKLRDNMGEDVRAFGSNKEQLYSILKNQTAGLEDDQKRLDEVLGQVNYYKKLESDGFTTMKVGVFGLWWIGGIIVGTARDNLGKLEPYLAEVRQTVDNKTTLNRVIEVAHNNTDQMHKSIDNAINALEYMHTQWTDLDNQYAGVLQKIDNAAGKADQNKFAYLKPTLKTAKDLWKRLNEDAVIIKEGIKELKVEPVTPQK

SEQ ID NO: 136 - protein, 353 aa, Bacillus sp.
MVKRDISARDLGGKEDTPFLLKKDEWIKIQKYTGDGAYLPVNVNEMRKALALENTAELPDFGELYTVNSSIKGHCKNWNDTTYREILDVASQIVNYSRRAEVFYAPLLVYLPDILEGDTVALEKFQKICKKLATEAKDFSDHAETLAKTVEQFANDTATDYKNLINVKDKYDALYGKNSEEEIRLRAEVEKLREELEEYIEDLEDFEEEVWLSLLLGPIFGFVLKEILESTKGKMLQAKIDATRQKIEATCATIQRNVYLMSLLDKADVGTDKTQKQIEEALPVINKIKAIWYSLHTDLLTLSNITMKDIHDDPEFADLGIELAIMQWVKVGKQADDFRINADVGFIVDQYIA

SEQ ID NO: 137 - protein, 284 aa, Bacillus sp.
MFDFDPHIITYSYLERMIVGMVTKVMTPSLKSLPDFIDDFNGIFGFMGNISDIMSTIFGIDVGGNSDIDDVLNNAELLQQMMDQMNSMQGSLADILEEQGMSIELIQKLTSLSNQQLALSTPINTELGKIEDILNNYLPAISNMLNEVYHETVQINAKVDKLLSLMMYAMKELDLIKDNVILNSSVVEITPHVQKLVYVNKKFLELSGNYMRSDISIDSMQELLQWAKSIVDTDMNSFVSTDTPGNKVFCSIHRAVVKSNNIFGRSLCNQARVYNHLIRRQCPG

SEQ ID NO: 138 - protein, 372 aa, Artificial Sequence
  Synthetic variant of native sequence
MPENNRYYNIQLKSNPKKVWNVSQASNDNDRAILLWQGGSADHEKFAFFQLDGGAYAIVNKNSGKVVTFGTGSWISGGPIPASETLQQQSWTGEAKQKWNLRDLGSNGDRSNNYEIVNQANGKVPSYRWIGSTVDNTEFLQLDNSNPSDADKVFTLFNGTGNLFGIDITFFNDTISVPKLPAIGTRPDVPDYTGGVNQQLPQTSNSVVVGASLIPYFMVKDNQANDYTKIHNSPYYTLVKEEYWDKTFSKVIQPGLSEAYSYKTGVSSVDQQKMTDTLSMNFGADLGIKFGDASASLKSEISRTIQTEISTTNSEATEETRSYTATGEPGKATGYTQYQLATKYTLKRADGSIVSDPWVVKNDKITVTRKTS

SEQ ID NO: 139 - protein, 373 aa, Artificial Sequence
  Synthetic variant of native sequence
MDRINIDGVRTGGPVSDGGNFSDTSGGQTFSDKELANIYLQHWKEGKYGNWRDGLYMSHGDFSDFPPEFKAGVMSPGYLIPQAQLPAIIEKIKNTEQLELMDLLQILTPETTVDKDVQKHRYLTVNTDKKTRINIDKTEVISAPIAAPQKVTNDTDQEGSATAPSISKKFTSTISRTDTHSTTLGMKQTIKGGIDFLGIAEGDFSQEFNESYTYSNASQKLTSDETTITSGTVTIKTQPHSAYKFDIIFQQVKNSGTVTGTSHLGGGYGSSGKDAYYDLSIYKKMKVIQDLYPQLWAVLQAKGIDVNDTTQEVNYTGAISFEGITGAKIDVTVKNLATGDVINRLITPTPVKPGTNMNITEQLQGTIQSIVSQ

SEQ ID NO: 140 - protein, 1133 aa, Artificial Sequence
  Synthetic variant of native sequence
MNPNEEYKTTVPHSNKIQPRYPLTNNPDHPLQHTNYKDWLQMCQNTSFDGENPVPSVTEVGAIGIAISIVSTLLSTFGAAVPGAALAVLGATLPFFDSGSGSVWEDFMIHNSSVLQKTLPESIKNQANTILTGLQESLIEYKRVFNIWKKDKTPAHAEQVRSTYRNTHNLFINRMSELRPSQYKQILLSVYCHAANLHLGLLVQGVAYYNEWYNVNPSLLTPDRTVDDEYLLLQDKIKEYIDYCSKTYREGLNILANSQANLKIYTTYQREMTFTVLDIITNFPYYDFKKYPIGVQSELTREIYTIEQQIKQIYLNHLTRQPNLVTHPFNSSIYHYRNLPFITSGFTAVRNRFWFTNARNLSVSGLYGSTSFDGQFDVSTQNVWKVEATYADVARRLKQLKFYAQLPNPITATTGTPNNSDYRELFTHEIPGRDGKLPTTFQTASHYLSYMMMTASESPGLSCAWRHASVNNDNLISPNKITLIPAVKARELDTSSKVVSGPGHTGGDLVEFNMAHGRLELQGSIGNVSQERFTIRLRYAAAANESPRHLLVTIPNIGVFPVMLLPTTYKLSLNEFSYNEFGFVDIIPSNESISFFASIPWIVSITSTRGSIDDKVYIDRLEFIPISRLPNRQRQQLEKTQQVVDGLFTSSEKQEIKMSTTDFRIDQTSTLVECLSDTEYPQEQLLLLDQVKYAKQLSQSRNLLSNTFGNQGWSTQGDVVLSSGGSLFKDSYFSLPGARTTQVGPDTFPTYMYQKIDESQLKPYTRYKVRGFIEASNHLEVAISRYGNEVKTMLHVPDDLATSSTRDNCGEWNRCETTQHFFTENTEEISKPAVSSTTCSPCDATHTSHKTCIDSHDFSFTIHTGDIDITNKPGIHILFKISDPDGFATLGNLEVIEDGPIFEDTISTVKYQEQRWKQNLIEQQQKTEQAFLQVQQAVDSLFQDSQYQTLQLEVTASQIHSAENLLQEISSMHNDIQSPKNEERFTALNNQIQQAYHLYSKRNMVRNGDFSEGLHYWSASSDASIQQTQDDSVLLIPSWSTQVSQQLRLQPNHRYLLRVAALKEHIGKGWIKISDCKHQVQTIHFSSCDENEIHHSIYQTKSIPFTPTTDQIRIDIGETEGSFTIRSIELICL

SEQ ID NO: 141 - protein, 626 aa, Artificial Sequence
  Synthetic variant of native sequence
MNPNEEYKTTVPHSNKIQPRYPLTNNPDHPLQHTNYKDWLQMCQNTSFDGENPVPSVTEVGAIGIAISIVSTLLSTFGAAVPGAALAVLGATLPFFDSGSGSVWEDFMIHNSSVLQKTLPESIKNQANTILTGLQESLIEYKRVFNIWKKDKTPAHAEQVRSTYRNTHNLFINRMSELRPSQYKQILLSVYCHAANLHLGLLVQGVAYYNEWYNVNPSLLTPDRTVDDEYLLLQDKIKEYIDYCSKTYREGLNILANSQANLKIYTTYQREMTFTVLDIITNFPYYDFKKYPIGVQSELTREIYTIEQQIKQIYLNHLTRQPNLVTHPFNSSIYHYRNLPFITSGFTAVRNRFWFTNARNLSVSGLYGSTSFDGQFDVSTQNVWKVEATYADVARRLKQLKFYAQLPNPITATTGTPNNSDYRELFTHEIPGRDGKLPTTFQTASHYLSYMMMTASESPGLSCAWRHASVNNDNLISPNKITLIPAVKARELDTSSKVVSGPGHTGGDLVEFNMAHGRLELQGSIGNVSQERFTIRLRYAAAANESPRHLLVTIPNIGVFPVMLLPTTYKLSLNEFSYNEFGFVDIIPSNESISFFASIPWIVSITSTRGSIDDKVYIDRLEFIPI

SEQ ID NO: 142 - protein, 303 aa, Artificial Sequence
  Synthetic variant of native sequence
MDSKNSVSKNQQYMAAEERPTVPVSTDEDYGIRSLAIDNKDTFYDVVRKIVGWNGIQDLSANFLHYAKPTYSVDLVAEPKDEPLSPVLIGKTNIQNKSQSTQKLQSASMSKTVTSTVTSTVTHGAKAGAKASAKLKVPLVAEAGVELNTEYNFASAGSNTSTETLTYTLPSQSIELEPGQRATVTSDLSMMKTSGEVQLRTKYEGYVHLKGTLINTPNNIDNNIKMGDFVDRFIKADSSLREYWHVNSPNDFIAYQVGKGNFTAEYGTVANITVEIFNQDGTDTTQPIKSYTYTVIPEVSKNI

SEQ ID NO: 143 - protein, 194 aa, Artificial Sequence
  Synthetic variant of native sequence
MAASFKTVIEVGPAHLDQAQALGRAFQDAIAPATVNYDFDHIRDAAAAIPDSSIVKMVRGWGLQEHAPVLVMVLSLKEAVRQALPPESAEASFWDTVERELVDAFTGLAAQEGLPGLSYYEEGADRTRYYRDLFFALQDEETGGHMYAIAFCIDVTIGLDKARVGALEMTDAVPFALRLNAIVLRQELTRALTA

SEQ ID NO: 144 - protein, 364 aa, Artificial Sequence
  Synthetic variant of native sequence
MATPEQNEYYNIKLKANTYKIWDVDNASSDNDRVIRLWGGSTTEANRQFVFFPLDGGAYAIVNKNSGKPVTFGNGAWFSINGGSSILAGADILQQQSWTGSANQQWYLRDQGNNNYEIVNQGNGKVASYAWGGTLAQNWEYVDLDESKPYDSNNVFNIANSGSSISLPNLPAKGDRPNAPDYNQTGRIDQQLPQTSESVVIGASLIPSIMVKDNSASDYTKIHNSPYYVLEKEEYWEKVRSEIVPAGGSSKYTVKRGVSTVDQQKMTDTLNMKFGTDLGFKFGDTTASIKSEISKTLQTEVSKTSTDATEETKEKGFSSTSGKDTGLTVYQLVTKYTLKRTDGSTVSSSYVRDGDQTLERTIAK

SEQ ID NO: 145 - protein, 297 aa, Artificial Sequence
  Synthetic variant of native sequence
MLNQGGAGNSGSGYLVNNMSEKHEDIIDPEDIFSNMLNAVGKYKEHKDPFLFVTRNSIGSLSSYSNFNAEQDGDPIIENESLLFVGESILTNNMNTEQTLKTNSFSKTMSNTVSSQVTHGFMLGTEARTSFGIPLIGETELSLKAEYNFSSSETNEISESYTYGVEPQEILVPPHSSVKVRVDLNTADISGKVKLMATPKTDFGDIDGYFHYGPDEQNIAESIPFTYNWNTLTKEVRQLNLPVDDIDYDFNNQTPKLVGSGKYKAKYGTTFKVEVIPINNPKAEGYSYSIQPTHTAN

SEQ ID NO: 146 - protein, 494 aa, Artificial Sequence
  Synthetic variant of native sequence
MAEKPPAQQQPQSSVKSVGGADDVYSNEINNPPFKIEGDALTLTKNFLSGDLAATAKKMWGSSLNLAVQSAQGKNVLNVNNLARDMVMVGTSAIPYGGVILSSIIGVLWPMSGTNQMQALMDKMGQIMDQKIEKYDNTTLTSKINAVEVALKRFETILYGTDDVYSDTNKAGEALRQATVIQNAFTELINESKKEEYETSELPAYTMAATAHLLFLSFMVTNGTSILGLEPDTMKNSYNNDLKNALSEYNSHIQRIGSDSDYKLSQLPQKIDAARVEIEKAKAGMNPPIGAAAGYWAEIYQQKSQELHNLLEQQKQLTDLVNSTTKNEAFAAALKSAKTTADNKGIKYEEKDSSKIVDGGTYKIISALNNGQYVDNQRETKNVSIYHNTRSDNQNWKFIFDSSKQAYKIQSVYDSRVLATSSSANYNVFTYNFDGSEDQFWIPEDIGNGTYIFKNKKYPDRVLDIFEGKAEDSTNITAYPRNNGAGQKFKVIQQ

SEQ ID NO: 147 - protein, 390 aa, Artificial Sequence
  Synthetic variant of native sequence
MKSISKKVMAGLGVGAMSLSIWAPSSQAAAPANNEYHTIHLAANTNIAWDVYKGWQTDDAGIVLWDGVRGDNEQFVFFPLDGGAYAIVNKNSGKPVGIGSAIIGSDGVRNFPSYNNQGLRQTSWTGAPNEQWYLRDKGNNNFEIVNQGSGKVASWAGVEMYGFKDYVDLDESNPSDKDRLFNIPAARSTFSLPTLPTVGTRPNAPDYNTSGAIDQQLPQTSNSVVVGASLIPSIMVKDNGASDYTKIHNSPYYVLVKEEYWEKVRSEIIPAGATSKYTVKSGVSEIDQKKMSDTLAMSFGSDLGLKFGESSLSIKSSVSRTIQTEVTKTSTNATEETEEKSIPSIPGKNTGFTAYQLVTKYTLKRTDGSVVTDPSIVRDSKQTIARTIAK

SEQ ID NO: 148 - protein, 387 aa, Artificial Sequence
  Synthetic variant of native sequence
MKSISKKIMAGLGVGAMSLSIWAPSSEAAAPAKNEYHTIHLAANTNLAWDVDNGSVDNDRAILLWNGDRNDNEQFLFFPLDGGSYAIVNKNSGKPVTFGGPTWSGSGGILGNQNLNQRSWTGSSNEQWYLRDRGNNNYEIVNQGNGKVASYAYQWASRHIEHVDLDESNPSDNDRLFHIPAAARSTFSLPTLPAVGTRPVAPEYTQGGSIDQQLPQTSNSVVVGASLVPCIMVKDSQASDYKKIHNSPYYTLVKEEYWDKTFSAVIPAGLTRNYTFKTGMTSVDQQKMTDTLSMKIGADFGLKFGDASASIKSEISKTIQTEISTTNTEATEETITSTVTSELGKTTGFTEYQLATKYTLKRADGSVVSDPWVVKNNKITVARKNSI

SEQ ID NO: 149 - protein, 271 aa, Artificial Sequence
  Synthetic variant of native sequence
MDVSNKNSAYQDIGERVKKMAQSAAWGGQEYRSHNIKDIELKGNLIDGSMVENSQVLTVSSDVLENNLGHTVNMPSTGYEHEFEETTSTTNTSGWKFGYNYNASFSVLMVSASQSFSVEYDMSTSDTHETKEKRKFTVPSIEVPVPAGKKYKVEYVFEKVKVSGKNKIDASLFGDVTYYYNNQPMSPQLLYSVQGLATDKQGFEQVIRDSAIGNDRFGIKTTGIGQFSTEFGTRLTRTLTDITDARNPVKLETKNIPVEFKTLSIDTRVIK

SEQ ID NO: 150 - protein, 314 aa, Artificial Sequence
  Synthetic variant of native sequence
MDVINLKKGFEQQKQIAADVDPIPVPIENVKGLQDLWLDSKEMKCPLADLIGTAPHNLSNLHFNFLYYKEPSYSVDVIKKNEEKPSSPVYMGTTNLSHSGGTSEQTLYSQAFSKTVTSSVTTTITHGAKVGAKAGAKLQVPLVGETSVELNAEYNFAKAGSETGTENVTYTVPSQPVKLQPGESAKITANLRMAKASGEVRLRTTYTGEIQSNFFVNTPYGPMEDSDTTGLGEWMKTLVDFNEDLKNQWTFSPTYASVAYQDGKGTYNATYGAVLDIHVDIFGGSNKGRKKRDADSTPIRSYSYEVTPEIVENN

SEQ ID NO: 151 - protein, 300 aa, Artificial Sequence
  Synthetic variant of native sequence
METPAINSKAKESYYSGTIDLMFINEFNKNCLSIDNNNSRTIIKDLKPAREQTESIDSFEVDNSNSNSTRIFKSQQKTYKNTDTVTVTHAKEFSFGQEISAELGAPKLLENLLNMAKINLKATFGQKITNSKAEAKSQEQSTTYGGDNIEVKPGQKVKVEYEYITNIYSGTLETLAPLKYNVKDPSMSYVSPKDIPYYKKTLPYVAKLSGGKKYSTDYEFFKDVHNTPDDWAVLIAYDKGDAYFFYAWELKDTTTLNDNKKQVYSKGSAKFEAVRGTGVKVKVTDLDTGKIVKDKVVSYF

SEQ ID NO: 152 - protein, 557 aa, Artificial Sequence
  Synthetic variant of native sequence
MEEKDKNIAQQGAEQGEPAEKDTTATQQQNTVQQKNPGTYYEDEKLNPIAQLDKWTQDLGKNTGAANYKTSLSAVEKIMPLLIKDITKDNYNNSLRAVTMFGAALIPYGGSFISPLIGLIWPESKDDAALKLKKQLDDLRKELSDLMDEKIDRFDQEGIQAAANVINENLKKLEDGIAGKTPGIFYDNQKKLEDGIAGKSEGSFYDSQSGFTVVYSINSAFELLLANASKPSFKMQELPLYTGLAAAHLQFLEFVKQNGKNPKIALTNENYNTFVNKIAEKTPVYTQHIEDTYNQFRSKIEQKMTPLLQGVIGVTSDEQQNLGAAFDKTIELQRKVVQITGGDRLGINSKDKQKLQTFIDNKENYKKLMETKSDYYNSTVGLFAVTQGIPSKIQKPETTPTWGPLKTLQGPVANGTYKIASKLDSNMLLDNDHNRNRLATLNKDITTKDNLWGLGWELRYNPDKQAYKFISKLGSDELATNGQDDTVFATTDRNDNDLRYWTLEPAAEDGYFFIKNKASGRVLDVTGGNTAAGTDIKTNVQNTPAVAAQLFKLETVQ

SEQ ID NO: 153 - protein, 271 aa, Artificial Sequence
  Synthetic variant of native sequence
MSEHGKNNVYQDLDERVKRMLISAAAPGTEYRYHNIIHAELNGGDVEGTLIENSETLTVSRNTLENNFDHEIELPTSGYEHEFTETTSTTNSTGWTFGYNYNVEISIPMVSGGHSFSVDYNMSTANTVEKSETRRFSVPSVLIPVPAGRKYLVEYRFEKQTVSGRNRINADLFGDAVYYFNNQPMSPQLLYSALRFATDTQGFEQVIRDSAVGNDRFGIRGTGVGQFRTEFGTSLYIRTTDITNSQEPVIIETITIPVKIETISEKTKVVE

SEQ ID NO: 154 - protein, 292 aa, Artificial Sequence
  Synthetic variant of native sequence
MDQISPIQKITQEQQNVAISDWREPFQKTYKSAKLRDPNRYFSNEAKIDLWGVYQSSVEADGSPTITNSKSLFVGRTILTNHTNQAQTLTTNEFSKSFGNSVTNSTTNGFNLGVSTSASFGIPLIGETGIEISTEYNFSNTAEKTKTESYMYTASPQNILVPANSSVEVIVNLNTAKLNGNVKLLSHVNGQLMWNTSKTGQKISTSFKGFLEKAARPNEIASNVKAHPRNGAYLIGKGKYSAEYGTEFSVTVRPVQKPSTVAAKSKSMVSEHSKTTSESYTYTVKPEVKKEQ

SEQ ID NO: 155 - protein, 349 aa, Artificial Sequence
  Synthetic variant of native sequence
MNTQESTPSVYPIQGTEFSDENGQVISPGAFATLSPYWLINDSNDQLLNFYNQVKQRLLDKQNTEQNMLKLDEYLNDLWFVGAVSELYATPTDYNKRLEASQLVRWYKNNNAARPTFEILESKLENVEPILDITEPIGYFATESEYTNNSPHQGEYLIPGWSNTTSTTYNTTTTKGFSIGANTGIEIPLPFMDKLGLTGSYNFSKAENVSTTDSTTLTIPVQTIQVSPFSHSKTSFYFQTHQYRAKFDVTSKFKADVGRDAEYTKKRSAFYLLAKYNEYLPKGIVVENGGKLTLEGKGEISVPNHINGFKLVKETKETPLLGGEGKTTKEIYTKDPNTNKLIPDASSKS

SEQ ID NO: 156 - protein, 945 aa, Artificial Sequence
  Synthetic variant of native sequence
MQMVTKAMNPKLGALPDFIDDFNGIFGFMGNITDVMSTIFGVDTGDSSIDDVLNNEELLKQMMEQMDTMQDSLEDILKNQEISKNIQEQILALTTDLATSINKELVKIEGILTTYLNAISGMLKDIYSQTSVIDQKVDKLLAMMTFALKELDYIKDNVVLNSSIVEITPHVQKLVYVNKKFLSLTRGFLQGEVLSIDSMQEIQEWAKSILATEMNSFEFSVDTLHNIIIGDNLYKRSALKTFSDVLLDDADQYGDFGTPLAKFYTFFSSLATLQINAYLCLTFARKVLGLSEIDYQVTMQDRIEQQNQMFVNLIQDKNYSNALETKGIYPMPHNVGDCNSFDLQAKNGYALIGLEFFMDNNIYKIKAYQGKIDKNFSLYADTVEEIISDDLSAVFPAITENAPRLDIVFPLSGELIGPPNTVITRIGLGTKYDKNRESDVRTFAYIDADFSLYDYISGTISKEGTQTVALEGNAQNGCRCYDMWPIGLIGDLYMTPLKGLSLTVDEGTLNMSGESYFSTILSREYNTNFILFPHSSNSGSINENLIRNGDLEEQDKYWEGTEPSFFVEGEGTFGSNALKVQAQGAFDQIVKLEPNTTYRLTAFTKVKDSNYSKGRIGIRDKYAYRVEESFLHTRYNQTKVEFTTGADTSKLSVFIQGGGDQESIAWADNIELYKVHQQDNMISDFNFDTYKYSNMCWELSGGGDLVEQEGLFNSKALKITNSGGAEQEVKLKANTNYIFTAYVKVDNTTAQIGCGSNQVSCNSTSYTPVKLKFRTGVDPSTTEGSIYCSNLNDSGTVWADNFVLCEAPNLIINGDFEQFDLSSWNLSPSEGGSIYLQSGLGMSRSNAIVLRGTGNEAGKISQKVPLKPFTKYRLTAYVKVSKGSIAHIGYGDNTCACAVDDFRQALVDFTTGANPMQSDDAIYLSSGNSKYTVADNFELYELDQI

SEQ ID NO: 157 - protein, 293 aa, Artificial Sequence
  Synthetic variant of native sequence
MDQVNPTEKNIRVKTNTSMGIIKWEDLIFDNLHVIGKNSGLPGKYQDTISLSSGYFWDVEYHQFSVEADGSPIMTDSNDTFVAKTTLTNDTDQEQTLSTNAFSKTITNSVSNTTTHGFKLGAKATAKLSVPLIGEVGTELSTEYNFSDTLARSNSGSYTYIGSPQNIKVPAHSSLEVIVKLETVTAKGNVRLLTKISGRDRGNFIYTEPELADHFDLSFNQIVEKASQYKDFKNIVANPDQETITLIGTGEYESKYGTEFSVTVKPIYTNNREKREINEGYTYKVKPQIIKHD

SEQ ID NO: 158 - protein, 558 aa, Artificial Sequence
  Synthetic variant of native sequence
MEEKKTEVQPQQATPNSNSLGAGGGSYESDALKALTDKINMDYLKKAGSVAADTLKAAYKDAHTSNGNYNNTFRTLTMTTSALIPYGGVLISPIIGLIWPEDLTAENNKMAALIKQLDEMMDTKVTDHVVRRLKTEVNDVKKQLELFEQNVNTGKHKSGSGLYSLTEEDGNAIDAKDIHKAFNSLLEHSKEEMQEVAALPIYTAMATAHLEFLHFLEQNGTKPIIGFTSNALNNILKTREGLENETFGQKIKDLADKYTKHVQETYNIGRDKYMAKMQAITTHSMNENDEYANLAYLKSLDDARSEMGYSQSKIDKIKNDIKNYQNLIKEKADFRDQTAENVAFKLTAMGKWNHQGDKWYYINNQGENQTGWLQDGSKYYYFSPEKTDKFEKGQMVTGKVTIDKGETYYFNPHGGQMQTGWIQDDGKQYYFSPANNTKNYDSESFKEGQMMTGWLAHLDHYYYMSPGDDKTNPYQKGKTFKKGEMWTGWLENPKKANEWYYMTPVARDYKVPHLIGNDDHIIRPVGSMLHDEYLEKQDSGDGWRYYFNESGINTHRYN

SEQ ID NO: 159 - protein, 300 aa, Artificial Sequence
  Synthetic variant of native sequence
MDTIPQKKLIQMQTTYLMTDQQAKDQAKQEVAQVNKDLSSLVGYSVDHASFQLISTNANTIELTSAEATGDSNIELGNYHNGTDLIQDYKVPGKKETNTSSATITNNEDASIGFESDTEFEIGIPLFAKGKETLKFTTNFKYSHGDSRTSTTTEEVTYPEQVLKCSPHGTTKLVSKVQKTNFTGKYSGKALITGVKDADGKSLNSEELFTLYTLNLAVDAAAHFGDPNYEGMKIPDSLEVDWQNHKIYAKSITTTFQGVAGHSSDANVEFIPDDKANQSVTMALSEYNRRIAAGISLYTK

SEQ ID NO: 160 - protein, 319 aa, Artificial Sequence
  Synthetic variant of native sequence
MTIVDIEQKAYEELKWYAIRELNAQANSFTNPSLYSYNINNADAVPDIVNFKSNPQILLTSVQVLSNDTSIQQSQTLKFSQKCTETTTTSTTTGYKIGTSIKSTTKGKIKVGFLMAGEIEQTVEVSLTGEYNHSTTQTTTSSHEELWEYTQPVLVPARSKVIATMYIMGGPVTVPMTLSANIAGTGVSPKGSPYSLSKIYFKKQNSSANSSLSARASVLYNPNWPGYSPVFTGVGENYSLNVEGASISSNTVSLYSYVEFKEYPLSTDTANLVAVPMREYYSTPILRDGTPALNPADSFTPYSRFASVDHNAHSMSEEE

SEQ ID NO: 161 - protein, 376 aa, Artificial Sequence
  Synthetic variant of native sequence
MAIDMSSCTKKDYNQSCVEQTDPGVNNRTYAMYETINRLVEEDTLNEQTNWSGKSWYNFIRFNYLILPSQEQEILHQLNRIDPSNVELSEVLRAINGYHNKTNLIQDYANTLKTTDLNATEYVEEPTVDSTSLQYKELNTVLKNPSNEALTKTGQIIGQKITSSTQVTNTHSIDVGRKFSMKNSVNIDVAKFIKAGVEITDEIHANYNYTNGTTTVNTKEDSVTTSPESVFLKPHTGAVITAKLSTPAYIGQLKGEMALDGYYTDQVNFYPTWVQLGIYNKFKVIAMHNPDIWEKLQELHFSLDDTYKKVNFEGKLTVSERKAPGSSFESSTQIYELDAKGDINYNKPVGVPDTKTGEVDIQLDMKKQKTLYLRTN

SEQ ID NO: 162 - protein, 1291 aa, Artificial Sequence
  Synthetic variant of native sequence
MTTLNELYPSYHNVLASPPVILADDPNSANGFKDMLKKLDDTWGEYDKDFLPKPVTASLSSLIDLFNKKPGSIVQFIQTGIRLAFLAVPGGQTYAWALNKIIGLCFPTSQPNLFEQIKEAVQQLIDTALVQTEINKNVNALNGMTLPIRYVSDAMQQAIGKPTFSSAYAGTDGCSTDASFSSTVYASSCDSTECSCSDAPDRNFCTADPCPSPCKCRLDAVYNQFDASRKTVENILTGMRTNLTTVLKPEEMTQYMQAFLPLYVAGATIMLSLYRSYIAFAQRYEYALGPNDTTKTTNDQLRVKISEESKYVYEQFSKYLPAVDSNTKGKLNAYIQYTRNITINALDQVSTWPFFDTWDYPSSDKAGTLSRPLSLAFNPTRIIFNDIVGPVECKTGSQDSSLLNLNPLYDIDGKALLINTITNYFYDNIQLKSLNFQTYNHDDNIYHQHFPLGFQATYSTRDNSTLKVNHTVPDGSNISLGNDIFGSYPAFNIINMSSSQLNAGLAYSDVSNISFDTFIPAGCSSQNKVSYPDHRIQAIYPVIPDSASRKKYDSYGNSDKPGFITTLIPNDTTTWITFTNLGINTFSAEQTTNTSGTKLVEYMNGAAALKLQPGQFAQYSINTSLFVLPSDFKYQVRVRAATTATGSLSIQVGETPAQTLQLPKTENQPGGIVGKQGTYMPIPASHSMDLTQRDTNLFTVPSTSSLSMSITNNSATDIILDRIEFIPLQAITPSNMSPRQFGPASTEQTETVAIRMDVYYGIKDIQAIVSSGGYAKFRYSRHSRRGSFIVYESTTDSNTWDYDGSFDTMDIIYLGTVNFLGGLIDYYHPSTIEDLENVTEQVYALFTSSSSTELAPTVSSYQINQVAMKVRALSDEVFCKEKALLRKLVNKAKQFLKARNLLVGGDFETLNKWLLGTQAIINDDSPLFNGDYLFLQPTNGIYSSYAYQKVDESKLKPYTRYKVSGFIGQSNRVELVVSRYGKEIDTILNVPYAAALPITSEPNPSCDNSQPDSHFFSYSIDVGPLHPELNPGIEFGLRIVQPNGYATVSNLEIMEERPLTDKEIQTINRKDQKWEKSVEQERAKISALLQPTIDQINSFFKDADWNGTILPHVTYQSLASVVLPALPKLRHWFMNDRAGEHYHILQELKHALDYVFTQLEEQNLIHNGNFTNGLTDWLVEGDAQITLLANNKPALQLSDWDASASQSLDISDFDENKQYKLRVYAKGTGTITVENCEESNPVSFDTDTFTSQEQIFYFDTPSFVLRMQSEGTEFVVGSVELIELSDEDTNE

SEQ ID NO: 163 - protein, 728 aa, Artificial Sequence
  Synthetic variant of native sequence
MTTLNELYPSYHNVLASPPVILADDPNSANGFKDMLKKLDDTWGEYDKDFLPKPVTASLSSLIDLFNKKPGSIVQFIQTGIRLAFLAVPGGQTYAWALNKIIGLCFPTSQPNLFEQIKEAVQQLIDTALVQTEINKNVNALNGMTLPIRYVSDAMQQAIGKPTFSSAYAGTDGCSTDASFSSTVYASSCDSTECSCSDAPDRNFCTADPCPSPCKCRLDAVYNQFDASRKTVENILTGMRTNLTTVLKPEEMTQYMQAFLPLYVAGATIMLSLYRSYIAFAQRYEYALGPNDTTKTTNDQLRVKISEESKYVYEQFSKYLPAVDSNTKGKLNAYIQYTRNITINALDQVSTWPFFDTWDYPSSDKAGTLSRPLSLAFNPTRIIFNDIVGPVECKTGSQDSSLLNLNPLYDIDGKALLINTITNYFYDNIQLKSLNFQTYNHDDNIYHQHFPLGFQATYSTRDNSTLKVNHTVPDGSNISLGNDIFGSYPAFNIINMSSSQLNAGLAYSDVSNISFDTFIPAGCSSQNKVSYPDHRIQAIYPVIPDSASRKKYDSYGNSDKPGFITTLIPNDTTTWITFTNLGINTFSAEQTTNTSGTKLVEYMNGAAALKLQPGQFAQYSINTSLFVLPSDFKYQVRVRAATTATGSLSIQVGETPAQTLQLPKTENQPGGIVGKQGTYMPIPASHSMDLTQRDTNLFTVPSTSSLSMSITNNSATDIILDRIEFIPL

SEQ ID NO: 164 - protein, 667 aa, Artificial Sequence
  Synthetic variant of native sequence
MNSYNKNEYEIVDSPYSSNNSNLYTNSRYPYVNNPSQFMQNTTYEDWLNLCKDNSKYNQDTNGFIDTPDTKTAVTAAITVVGAILTYAGVPGAGAFTLLGKVVPVFWPSASDKSQNIWVKFIESIQDILGKKLDINKRNKAIDKLEGLQSVIYNYNASLKSWLENKNNSSFQTDVVKGNFIYANNAFIESMNVFTSSSGNSKEKEENVLLLPIYTHIANLHLLLLRDASFYGKYWGFSGAEINDFYSKQQQDTITHIAHCIKYYNEGLTIAKEAFQLEDKWNKFNSYRRNMTLKVLDVISLFSTYDTKRYPATIEKPNINELGKFELTREVYTDAFSDPGSSLNSSLTMDELDKKFTRGPHLFDQLIKLFLYTRFSHDTFGFTGNKNCTALINNNFCQEAQYGDIQKADTESTFSINQLINKINVTHVRNNPGAIIRMDFYKEQNLLFQYNSGSKATLVDVKTVQISNQIDSSIPNSETYKHNFSYLKTGNNPTNPNLKIRQVAFAWTHWSVDSNNTIQEKVITAIPIIKSQSVNDTTIIPNPGHLGGDFIQFNPGTSPRIELQCRASNFPTTKNYAVRIRYVANQKFTVSVSIAGRATTFITADTMAASTQGKYLYQQFSYGDVFTKSLPVPLSPRQLLTISITTLSPINQNTIFAIDRIEFIPVD

SEQ ID NO: 165 - protein, 376 aa, Artificial Sequence
  Synthetic variant of native sequence
MAENTVQTIQVSNMKKNMTSYKDFEYQLGPEGLREAMATTGSNALVMDLYALTLIKQQNADFTNVDIIDEKLRAAITTHQNVGRSNATKWLDMLKPKLITTNQNIINYNTKFQNYYDTLLDAVDATDKATLKKGLSNLNTSISIYKKDVDNLIAELISFRDRMATDTQNFKADTSSLVSILTSEDSGLPILQQQIDAYNAAIAKDNAIIIGGSVALGLGAVGIIGGGILIGTGAGSGLGVTLVVGGVSAIAGGTTAIVLAKQNIDSSREGIRDLTLNLNDTKAQMVVVNNIKNQCIYLSDTIDLAIVALQNISNQWHSMSARYTTLIENVDSINPNEFAFIKEDLHVASDSWKDIKEYADKLYTDIKVVETDGPEL

SEQ ID NO: 166 - protein, 309 aa, Artificial Sequence
  Synthetic variant of native sequence
MDSNNIVNKVPEQQQPLKSQDPVSVPSEDVKGLQDLWQRKDIKTALAMVASVSFDDLRSIGGFNFLYYQKPSYSVELIGNPKNEPSSPVYLGTSNLSHSGGTSEQTLSSAAFSKAVTSTVSATTTHGAKVGAKAGAKLQVPLVAEASVELNAEYNFANAGTETNTETVTYTVPSQNVKLKPGETAKVTASLRMIEASGDVNLRTTYTGKVESNYERYIGHGMGEISDTNKSGLGSWIQALAFLDSDLNNYWSYSNSDHDVVYQDGKGKFKATYGTLVDIKVEISKETDSKDNTPIRSYSYTVTPEITKK

SEQ ID NO: 167 - protein, 292 aa, Artificial Sequence
  Synthetic variant of native sequence
MAEINSIQSAAQEQGSVSISDWREPFRNAYKIAQKHDPYTYFGEDATEYTLGNVYQSSVEADGSPTITGSKSLFAGRTTLTNDSDQEQTLTTDQFSKTFENSVTNSTTNGFNLGVSASSSFGIPLIGETSVEISTEYNFSSTEEKTKSESYTYTASPQNIKVPAHSSVEVIVNLNTAKISGNVKLLSKIDGTFTHASGGDGSNTASRGLWVLEYDASPYEKLSDLKSARVGAEAYGPVYLVGSGKYSAEYGTEFAVTVRPVEKPNGFKSMIAENSKSTNEGYTYKVKPEIKK

SEQ ID NO: 168 - protein, 541 aa, Artificial Sequence
  Synthetic variant of native sequence
MPILWPDDEEPQKVWEDLINHGDKFFDEKIGKIEKARAKTFIAGMKNELGKYEKALEDWKANKNQDTAATVQEEFDDAGDYLDTKMEELKIEGYEQTLLSCYAQAALMHLNLLSQGVQYADEWRKNNPGQTSKYWREMLTKGDKNRRGRIEAYMDYCTKTYREGLNKVKNVPNITWYTYNSYRREMTLAVLDLIALFPNYDVDRYPKGTKSELTREIYMDNGYTKDVDVGDLPELDQALTRRPHLFDSLAELKLIPSNVGLAHCLIKSRRINNDVLVGYDLPGSRHLSSLPIIGVNVEWREKHFHGGKLCDRANTGIEILTWIPDFGVTQSSIFKMEDGGGCIEHGNGIQPPRKNAKRDPLGGYSHRLSYMSVREAQNPSFYMYSYAWTHLSVDEKNTIAKDTITQIPAVKAVEQNNDFVVIAGPGHTGGDLVKLNGITKQGLKLKCVFPQNKKYKIRLRYAADNDTRVNIAVPDSDGTTAYWIDAKKTYPGVELKYNNFKYLDTDAIVNTPNKAVTIAIKNALKDTSIILDRIEFIPQEG

SEQ ID NO: 169 - protein, 216 aa, Artificial Sequence
  Synthetic variant of native sequence
MYNKRIIDLEIPSYNAINFLEIYRLPLVYLNQALNITQHLQKSLSLQTLNLEFDQLNNLISEIPGGSILNTINQKIEYSEINTKCAINNIVDIVKSNCEMFEDDFSLQSKLESVISNVFLNLANQEENPYVFYHEKLSYNTSYSYHVIFIIDNMESNLNVFPISFNVNVDSNYENLNRNSIKDLHSYKIKISGINFVISKNSELAEMVERVTESIL

SEQ ID NO: 170 - protein, 332 aa, Artificial Sequence
  Synthetic variant of native sequence
MEQNIQGQQSNEKYALGAEGFKEEVGHSGSSILVMDSYAKIIFNNSQEIDFNGVNSISNELKTNIVSHQRAARNNAAYWLENIRPNMLQTVQDIVDYNTIFQVSYSTMADAIVQKNNKKLKVELENLYTMILENQKKSDELLTKLITFRDKMTVDTQNFKIDVADVSAILAEKETGIPLLKQQINSYNDVIKKNNDTILYGEILCATGLWIIGGPMIAVALDNIDDAEEEIQNLMSQISIAQEESICLTNIKNKVIYLTDTIDVAIDSLQNISNRWHTIGAKYNNLLQNLNLLDSNELTFIKEDLNTAKDSWQDLSDYAHELNKGIHEIEKN

SEQ ID NO: 171 - protein, 343 aa, Artificial Sequence
  Synthetic variant of native sequence
MAETETQLNRSTENSYSLQKADAESYIDIVQDRMKQRDRESKCTGKPINMQEQIIDGWFLSRIWIFKDQNNSHQTNRFISWFKDNLASSKGYESIATQMGLNIESLNDMETSNINYTSKTGDTIYNGVSELTNNTGTTQKMKTDSFQRDYTKSQTTSVTNGLQVGFKVTAKGVLFLAGADFETSVNYNLSTTTAQTNTISDKFTVPSQEVTLAPGHKAIVKHDLRKMVYSGTHDLKGDLKVSFNDKEIVQKFIYPNYREINLSDIRKTMIAIDEWNHVKPIDFYQLVGIKNQIKNGDTIYIDTPANFTFNGANPYYRATFTEYDADGKPIKTKKLSENYKLKN

SEQ ID NO: 172 - protein, 287 aa, Artificial Sequence
  Synthetic variant of native sequence
MAQIGSVQNIAQQQNAYIADWREPFEAAYKYMHNLHDDYFISETAEYKLTNVYQTSVEQIGSPTITNSSSLFVGRSTLTNNTNQDQTLTTNEFSKTFENSVTNATTNGFNLGASASATFKIPLVGETSIELSTEYNFSDTKETTKSESYTYTASAQNIVVPANSSVEVVVSLNTAKINGNVNLLSRMDGTITYDRSLNGGYNSSKFTESLGSFTKTALLWGSQPGLRVDNNNNLYLVGKGTYSAEYGTEFLVSVRPVEKPKGLAATPSKLNNEGYTYTVKPEIKKEQ

SEQ ID NO: 173 - protein, 315 aa, Artificial Sequence
  Synthetic variant of native sequence
MAANEYQFLTENDLRNGVKQAIPSFLDKNKPYGMYVEYNGSKWKRVIDPKELDQWYQYPQLVNAVKDIFRASYTNYVGLKDLTIENQDSKITSLRKVGDPELIQLGTSELVNTDSETKQNLTSAPFSKAFTSTSTVTVTRGVNLGFKVGSKIAIPLVGADISTEFSRNTNWSTNHTTTSTSTDTYTAPAQTISVPPRTKAIVTYVLSKQQYEGEIALKGDLTGSMFLYDPYIVAYPGMPEQQRLLYTSTLYNLFDKSGVQLPAGLSLDRGNQKIKFNGTAKLKVYGGQMHDVVLKIVSLDDPNKVIEERKIPKKN

SEQ ID NO: 174 - protein, 287 aa, Artificial Sequence
  Synthetic variant of native sequence
MDTIKNDSNFLNTKLGQVGQEGALQDIDNILNQLVDSINKNSPLMTHIALADNGIVNYSGININQSNVTNVIPLFLGNNTFSNTSSEEQSYNTSIFSQAITYTKSTSIQNGFKTGLKVGGKAGIPFVAEGAVETSLEYNFSSTGTSTSSETNTITAPSQPVKVPAGKTYKVEVYFEKKSTSGTVDLFADVNQGVRGNRLHPDFAKLSHFLYRAEDKHGVIQTPNDPDSIRIKGSGNFRIEYGTNLIVKTYDISSKPNLKFRSLINSELESDILVNEQIIPLKSPNKK

SEQ ID NO: 175 - protein, 234 aa, Artificial Sequence
  Synthetic variant of native sequence
MTSIYLKKNECIRNLRNPPIRRITLKVPCKNKGNLKNIFQVEPQYINQALTASNAFQGAIDSNLHFNYERAYQIGVNMPGRDYDPSMWGINQPVIQETLQVSSMINQLKSILNRFLYFIDISDEPFWNEVEAVIVNTFTNLYTQQNSAWIFYHSSTSTSTSYYYNIMFALQDSNYRTMIVIPIAFDITVRLEKQKVLFITLKDRAEYRVTLKSIWVRLILQKNQDKQIVDCFNS

SEQ ID NO: 176 - protein, 354 aa, Artificial Sequence
  Synthetic variant of native sequence
MATNNITISQASSDTFKEVNISTLRGDLYERFVTLFEGNPRLLGINSDGKKLTDKDKQQIRSFAQAIRDDNFKNIDDIDKLTKGQFKKGTFIAPFMNWSPQYSNLTTNYDLKATPGDVKHESVEVYKYKNPKNSVEQTFKTDEKEVEIGHTFTETHATGGKFGYSNTTTFKVGVPLNQATTTHTFTFEANYNYTNTHTKTDKETKRYPSQTVKCEPGYITQLTIDKSTATYFGELEFNIGSSAKELMNQINQNIKDINAFSKNKLSVIQPDEEELMYTLYKYSGYDIPSYVTLDDEHKTVSFGKIKSTYTGVTGTASDMILELTPIDSKDTTKKSIKMPFKEYQQKRKNNEPII

SEQ ID NO: 177 - protein, 192 aa, Artificial Sequence
  Synthetic variant of native sequence
MAASFRTVVEVAPDHLDQARSIDRVFQEAIAPATVNFDFEAIHRAASAVPDSDVVKMVRGWGLQEYAPVLVMVLSLKEAVRQALPPECAEAGFWATVERELVQAFTGLAAQEGQPGLSFYEESGDRTRFYRDLFFALQDEETGDHMYALAFCVDVTVELPKAETLALDLTDIVPFAVRLNAIVVRQALSVAV

SEQ ID NO: 178 - protein, 789 aa, Artificial Sequence
  Synthetic variant of native sequence
MQEKQEQGLKETQVTPFNELKEKITENPNLDNSRMWNPYKGVDYVKFMNALNSNVWKPVLTDAVKNEGENVVPVLIKGAIVMGLSLAPPPLPMLGTVVDLFQFTDGKTDDAWSRTVEYVNKTIDSKIEQYHSYLMSSELVALGSSLGEYKRVLEIYETNKLTRVEDPAAGVREQFRISNDKAKAFIAKLQHPQNQGDTRYNVLTLPLFAQAANLHLALLRDAIVCDWGIDSNQLQGYKDELKKSIIDYTNYINKTYKEGLEQEKNKAADYSDPESYIQAGKSDVPVLRQWFPEVMKWNRVANYERQMSASVLDLAAVLPTYDPDNYSKQPIVKQSRPIFAPIIGIPGGLKSKDSAGTFGSYVFDVKNFDQINTELAKSPYDYLAYGGALNQIGIRTSGYIYGSSTNTTYYTNMTHGSTAGNQTNISINPNNPITSISGTAGTKPYTLSFQFADGGTTQTLGSNVPNVNCYAPFKFEYPGYQLSAVRVFGTSASTGDADAMVFAFRSTEIGDTHQLMANVPTQIPAEIGYGQENTLNEVINGQNAIEMNNGNTMKYSINSPKTQQYKVRYRVAANEESSVRLQNMDTNISKTTDTSNTSRNTVKGEYGYYKLVEGPTITLNKGINTVTLQGTKGKFALDYIEVEPIVQDERVYFEDFIGDLKSSWYGSNAGFAPGYGTVHENGELYTFINEKVEKYSQYTMRVKLKLNSNDPNVRENVRLFTDNAKGERITKEVTLKGGANYQEFKLEFMTNDNLDKTHIGVQKASGSNTVFVKDVEVIGTPNDNATPYK

SEQ ID NO: 179 - protein, 645 aa, Artificial Sequence
  Synthetic variant of native sequence
MQEKQEQGLKETQVTPFNELKEKITENPNLDNSRMWNPYKGVDYVKFMNALNSNVWKPVLTDAVKNEGENVVPVLIKGAIVMGLSLAPPPLPMLGTVVDLFQFTDGKTDDAWSRTVEYVNKTIDSKIEQYHSYLMSSELVALGSSLGEYKRVLEIYETNKLTRVEDPAAGVREQFRISNDKAKAFIAKLQHPQNQGDTRYNVLTLPLFAQAANLHLALLRDAIVCDWGIDSNQLQGYKDELKKSIIDYTNYINKTYKEGLEQEKNKAADYSDPESYIQAGKSDVPVLRQWFPEVMKWNRVANYERQMSASVLDLAAVLPTYDPDNYSKQPIVKQSRPIFAPIIGIPGGLKSKDSAGTFGSYVFDVKNFDQINTELAKSPYDYLAYGGALNQIGIRTSGYIYGSSTNTTYYTNMTHGSTAGNQTNISINPNNPITSISGTAGTKPYTLSFQFADGGTTQTLGSNVPNVNCYAPFKFEYPGYQLSAVRVFGTSASTGDADAMVFAFRSTEIGDTHQLMANVPTQIPAEIGYGQENTLNEVINGQNAIEMNNGNTMKYSINSPKTQQYKVRYRVAANEESSVRLQNMDTNISKTTDTSNTSRNTVKGEYGYYKLVEGPTITLNKGINTVTLQGTKGKFALDYIEVEPI

SEQ ID NO: 180 - protein, 308 aa, Artificial Sequence
  Synthetic variant of native sequence
MLKNISDVNQDRIVDVSETMEFIAQNYYEIHMKDKLLLCWVSGSDGYMIRKLDKITPGETWSEIEQSSIQTSNLQLSPEHLENVQVSLLDNTLNINQAMSSTSYCKAVTNTSTTQTNQGVKASAEAKLLPIPLIMPDGIKLTADVNSSTDTNISKTTTETIIVPPQTVIVKPHHKVKVTAEFYTNKYSGDIIYNTKVNKSSTGLKVNAEYYVPFNPFIGWLTPNRHDTITLDNYEMYRGDDSSIEKRLIQAGVKFNADGSMQALCKTHFDSTSGSYAKISVIDVTNLSCPLILKEQVYKNFQTNNSNS

SEQ ID NO: 181 - protein, 477 aa, Artificial Sequence
  Synthetic variant of native sequence
MAATNAQKGTDIIQIMSDGSIKIVNDQLDKQSPAKILTNLGGSAFINLVKGAQNNGMTTVNNTARDIVMAGTSGIPYGGAIISSLIGLLWPQDGVNQMKQMMEEMAKMMDQKIEDFDKAGLNQQIKDAQGALREMELVLYGDGSGSTRSLPGTASEKAGLAHSKLMTALSAAQKEGYDRTELPAYTAAATAHLLFLSFMVENGESPLFKIDSDSMNRTYKIYLKEAISDYKTHINRTVGDGRNSLYQANYRIQEINKEIARLAKRQETSGPKGFLQLQDKVNEQLGYKNDVLKDKAKFDNYVNSTVNNAAFNEALNFAIDTATKNKISITDPRSQIANGVYVIASGLDNHMVLDNDNGTHHNVATYEEHDGKNQRWLISYEKNKQAYKIQNLGDNGPVLATGSSANYNVFGYEFSGSDDQYWIPESVGDGYYILKNKAFPDRVLDVSNGKIGNGTNVTIYPRDAKNPANQKFKFIAQ

SEQ ID NO: 182 - protein, 312 aa, Artificial Sequence
  Synthetic variant of native sequence
MAPVASVVNDQFGQGSTYSTENISNVLFVRLRAGIEASPELRQKFKIADDEKIQFETGEGGGTIGGDKVNAINYGLRDQLSKVTASSTGTNITVNPTTVTEVEAGKIELLSYRNDTPITQKQFTTEKQVKRVDTVTATNQYGFKLGFESTTSFEVNALVAKAEQSFKATAEFNFSHTDTNTVTNEETVTFKAQEVQAAVGGTTNYFTRVGKAEFSGSFQTDAALTDLKLKLPIVKQGNNETVVHTEEVTLTSQDIYTIFKNTPYIPLPAYLSFDDNGKKVLVKNVTFNYTGEMGYNTAAQAEFIPFDQDNPK

SEQ ID NO: 183 - protein, 304 aa, Artificial Sequence
  Synthetic variant of native sequence
MIVDVERDLIDNNEWYARVTYNANPSTFRNQSVYDMNVSDLDVVPITTEFESTPQLTNSASQIVRNYTSKDQSQTVLFSEKSIETFSRSTTEGYKIGSSIKSTTSFKVKVGFLVSGEISQSIEVAVTGEYNHSSTETTTTTNEKLWQVTQPVIIPPYTQVTATLQIFSGPFVVPAKTKATIQGKGTNNGAYNFASVITYTDYGGKTWTDRNRAQALYTDRGQWPGYKPIYVGGSSSTDPTGLLRLEGEARINAQVGLYAVTEFKESPLPGYADIGSNRTYYAPNIILGDGRIIPVPGYQRYLQR

SEQ ID NO: 184 - protein, 935 aa, Artificial Sequence
  Synthetic variant of native sequence
MFSSALDNTSVLLNLIEKGINEGDDLLGLFSFIGLTALEAIPIVGGALSKLISIIFFSSKPSISYQKIWEELVKAINQIVDKKIEEALVSELIQELSGFANVLEEYRDAYDLYNGKRVFEIPDNLTPEEYLVTVFTAANLQFLQRIPRFQNPKFDVVFLPFFVHVAEMHILLIRDAAIHGLEWGMDEKMNQKFKKDLKNCIEEYTTYLLKIYKKGLKEASERELKDKDFPTTRDKKHYINTVRWNVINQYKRGMTLTVFDFAYRWKYYQEDYRNNITLNPIRTIYSDIAGSVYPYEKTTNEIDITIKDQNVKYRGLLKKLQVYHAERIDSIQSTYLRNHEIINSNKIGGTGGRISSLDLEDHINNPLIQVNMWSELVPISLGFKFYNEKEEKIGGGSWWPNPHKFGAYHFVGNKVSSIIGFGKNETGGFNSLDAMAVGFKLDDYDSKNRLFGINKNGEPVTKVIDAGNFYKDNFKSNIHKADEPIFGDGILQFTNYLSHQNQDSSVMYQIHVEIEGTYQLHAIIGAKKQREKLSIKVILNDEQQKNLITDYFDSSNTWTGMSLNNEWVYKRVLIGNFQLKRGINNINIHNSILQDSANIKTWNLGSIELTMDTNSIKDPDVTTLYDKDNYAGTKRFIFEDTRRLIDFNDRTSSIKVGSYVPGLRFYEHYDYGGGFIDLGSGEKLSLKNHRLNKKLSSAKFANLVLYKEDDYKGEKTLIFHDIPYLTDFNDKTSSLVVSSNVSGIVRLFEHSFYNGEYIDVSGGQKISLKGHNLNRRISSIKFLKEHEVFNGLYEIVTAINNKSVVDWSKDKNSNVHLWERRNQDNQKWYFKYDSEKQAFQIISKADEYEVLAWNDFKNSMNVFATYNSKKDEHYWILDYLGEGNYLIRNKKKQNLVLDVDGHKTANGTNIKVNEQHALDNPSIEAQKFKINLVDN

SEQ ID NO: 185 - protein, 459 aa, Artificial Sequence
  Synthetic variant of native sequence
MEEQGGIKEQLTKLKDEINAETDKKIAQQHLIDLDSKFSDLLENLNKLENSVKSKKAEMYYDSQGSIEESRRIWVGIIESKFGEILTLAKQEKNKVNELPLYTQVATAHISFLKNLEINGPGPNYKFDPQSLKYFYNTKHIQETIDKYTTYIKNTFDDFHIKNIEKIYKVYGSPIDPYIFATSEGRELVKQKLNKLLLEAKATLDKINNETVWLGGWAAHGRSVEKATDELNNVKVAVNAADFSSKLFETTIADESFNTIASLGTWIEKDGKHYYNDRYGEMVTEWLNIGKKTYFFSPEDNVENLSGIKFKKGEMITGWVNTEENMESNQIRSYLFVDEEEGLKNSAGELFTLGQMMTGWHKTMDGKDKEFWYYFTSEEEGLKNSAGELFTLGQMMTGWHKTMDEKGKEFWYYFSPKEEGLKNFAGKLFTLGQMMTGTVKIGNKGYTFAENGVCTNPNI

SEQ ID NO: 186 - protein, 463 aa, Artificial Sequence
  Synthetic variant of native sequence
MIDNNNQTTNIMDQFSDLMNEKIKNYNRQNIKATLKALHHELKALDDSLNGKRVSESYYASDSPDEHNRNRVRFIHSNFKALILQCSKEGYEEPELPLYTAVATAHILFLRCIEKHGLGPKLQFHISDYNEFMKDLKDYPDKYIKHIKETYPKGSSKLFKEPTLVPKYYAETKGNKAFWMAVKRNTLVPQNGKWYYLDRDGKMKTGWVKTGGFIMDDNGQLEMHQPDAYYYFSSNGPMVTGWFTDADGRTYYLNPEETQKFYKGQMAEGFVEIGKGKWFYFNPLDISRLAPNGYDNLPEAGKKLLKDTFGISKNILRGEQRTEWIHDNGAWYYCSPEKNNRFDKGQMVTGEVNIKNSEGNIKTYQFNNDGACTNTYQKMVLQYFMVVVPFFIAYQLFYTNEYLNLEIIFCPSKLFKTFFNLGELTYYFKRRSSLYLSNFCYPTITRILILLYIITLLKFYNYL

SEQ ID NO: 187 - protein, 291 aa, Artificial Sequence
  Synthetic variant of native sequence
MDTTEKVPQDVSKIQEQNKKQQGIQDWQGPIDFTIGQFFQKKTGNNVAHILTRYDNPKFIETTAVASSSPKITDLKEVYVGRSILRNNTDIDQTLYTDSYSETITESTTSAVTHGFNIGESTTASLSLPIVGAGFEQEVHMEYNISTENSTTKEKSRTYTAPSQAIVVPAHSSVEVIVKLDRIKADGKVDLFSKMKDTQYTSLVWFKDRPDQMFVGSVYDAVRDVTSDQTFPDIKANKKDKTISLIGKGNYKAVLGTTFSVNVKPVNKEGRAINDGYTYKVNPQITDVKIK

SEQ ID NO: 188 - protein, 575 aa, Artificial Sequence
  Synthetic variant of native sequence
MDQTSRLDDFIKNDEAGHYGKNRDGFYIKSPDEARVLPQGGSWFTHDTHYRDAEIAPFFLIDESKMDSIIKEVQNKKDMELTDLLEIITLHAPSKEMDGEDNDAHLVRYCRTPGIDKDVKNHEYLTVDTGKSKIVSTKIEKADAKDDVNLLTNTFTNPTDGPIQATSGTISKQFTNTISTTQTNATTLGMKQTLKTGIDFFDIAKEDFSLEFNESYTYTNAHQTLTSEATTLTSGSVSVNIKPGKSYKVQTMMRRDKESGIMQGTSRLGGEYTISNGDYRVDLNIYKKFKVIQDFYPKLWAVLKDRGIDLDDNTQEVLYTGGIGFDSIRGANIITTITDLDTGNKIEKPVSQVKATGTINLDGPIQASIQTGIAELEKNSLKLQTIDGVTYCVDKDGNHLTGWQTVSGTQYYFGHNGDGSGLIHEGEMAKGWKKLDGVQYYFNKTGDGSGMTHEGEMAKGFKTIDGVPYYFGQTGDGAGMNYEGEMAKGWKTIDGKTYYFGQTGDGAGMNHEGQMATDWTTINGVKYYFGKAGDGIASLAVGERATGSMMIDGQVHYFNKTGDGTGYHHEGELEW

SEQ ID NO: 189 - protein, 583 aa, Artificial Sequence
  Synthetic variant of native sequence
MDEKQTEVQQQQADAPPSTGPVFKKEKDGTFTVLKKNIFNMATLKAIGSLGGAGLKQAYADYQVDGGNFNNTFRTLAMGSAALIPYGGVVLSPLIGLLWSEDKTAEANQLKKLMESIAAQTHEQIAKYDTAKLSKALQDLHEKVEEFENLVPIPGSGIFYSGDQIHKYENIQISAKNLNNYFRSAIAACQTEGYKESELPIYIILATMHMNFMNYVIKNGENLLHFDPEVLKSEFTDKQDGYIHGVHNVPGQSEKVGYIEYIHNFAKKDLDLTSNFERFLLDYKFKLDHDKALSIGSSPAKLISSIVMNHNNKLEKTLNNSINNIAFKQAANIKSEFTLDQNGRPLYYSLDGKMQTGWKEIGTSFATRHDTGSSTAERLFSREWLKAQGIQYSWYYFSPTKTDKFEQGEMYVDTTQTLPDGKTYTFDSDGKCLNPDGGAVNVQILKETYKIVSKLDNNMVLNTSDHQAVLKGTNEDTWGNSWTFQYDNEKHAYLITNGQSGGPWKLAEYSNTNTVFATDDKANKQEHYWTLEPGGDGYFFIHNKSQPDKVLDITGSNRAAGTKIGLFNKNGQDNQKFKLEKIN

SEQ ID NO: 190 - protein, 1030 aa, Artificial Sequence
  Synthetic variant of native sequence
MAHLSDFYPISYNVLSQKSVYNDNEMYEVQQIFKNVLTSWEQYSQDGRISTQQQELKKAIHNLKKYNLDLFDLFINILPLGATISPLPPVHSNDVMISTIIPNICFIVDIVWPQIPKGLNTQLNMWEVIKDRVKKITNQKIEINNYEQILTTLNQVKIHLLDLKNAIQTTVDQSLSYQNITADNNVYHPYKDQEFNAIIRIQLANVLAQFDQYISIFQMNNCVIIELPYFCLLATLHLFTLQSVVHFGSQWGYSTMQIKDYSKKLQQKIKEYTNHVYSICINPSHIHRLNDSKNSLYKLDSLFSNMINECCNYIAIWPLLDPVDYPIRTHLEQIHIPFSNIITSENATFELNNHIQKKTFQSHNLSKKTNLNKIATIGEVDRNSGVIMIAGVPVVIGITNGQYVTEHITKTSAIKLSKNQIIELPFFNLTTGLYQIRYRLSTTESGFLHFKLGRWDNIVSLEQIETYNHSTLDFGGKPGIYKLPSKKVTPRCGNLSSIDNILAINSGHHILTISNIGSVNIVVDRIEFIYISNMDSPHSPMVFNNKKYLEKIKRQVNQLFTDTLKNKLKKEISDYHIDQIALKIDKLSNKAFQLEKKYLRQLINKAKRLSKERNKLVGGNFEKLDKWLLGYDVVKKYNKKICKGEYLLLPPPEKGLSYIYQKVDESKLKPYTRYIISGYIIQSENLELIVSRYGNEIQTLLNVPHINENTFHNQKHVNSHFFSYTIDVGMLHPEINLGIELGLRIVHPYGFAKLSNLEIRESHSLTNYNTLKRQDSLYVNKYQNQNRGLYRNPTYQINNMKIKDNHSLTMQEIIQKETIWKNKFDNENKKFIIDLTSIINQINTFYKDLNWNNTIHPHVTYQKINQVKLPKLSNLKHWFMNDRPGEHYKIIQTLQNALDCAFIQLENQNLIRNGGFTNGLENWTIQGQVKIVTFIPNKQTVQLSCWDAYMVQTINIKEFDTIHTYKLRVYGKGTGNIVIQHSDYVELMSFSTNEFIFKELLFSLKTNIIEVLIQSEGPKFFIDSIEIFKY

SEQ ID NO: 191 - protein, 531 aa, Artificial Sequence
  Synthetic variant of native sequence
MAHLSDFYPISYNVLSQKSVYNDNEMYEVQQIFKNVLTSWEQYSQDGRISTQQQELKKAIHNLKKYNLDLFDLFINILPLGATISPLPPVHSNDVMISTIIPNICFIVDIVWPQIPKGLNTQLNMWEVIKDRVKKITNQKIEINNYEQILTTLNQVKIHLLDLKNAIQTTVDQSLSYQNITADNNVYHPYKDQEFNAIIRIQLANVLAQFDQYISIFQMNNCVIIELPYFCLLATLHLFTLQSVVHFGSQWGYSTMQIKDYSKKLQQKIKEYTNHVYSICINPSHIHRLNDSKNSLYKLDSLFSNMINECCNYIAIWPLLDPVDYPIRTHLEQIHIPFSNIITSENATFELNNHIQKKTFQSHNLSKKTNLNKIATIGEVDRNSGVIMIAGVPVVIGITNGQYVTEHITKTSAIKLSKNQIIELPFFNLTTGLYQIRYRLSTTESGFLHFKLGRWDNIVSLEQIETYNHSTLDFGGKPGIYKLPSKKVTPRCGNLSSIDNILAINSGHHILTISNIGSVNIVVDRIEFIYI

SEQ ID NO: 192 - protein, 361 aa, Artificial Sequence
  Synthetic variant of native sequence
MATLNLSEESKKFQSITFAESTEQYGLRQYPNLNENPTNRVFNDAYHKELADQYGFIFYKLDADDQFIIANRNTGEVLQAPGTTGPDSVVLHKQYDASIGQKITKKQLTKDNFQLYVYNSTGIISAPYDKVGEWVNIVSLPKNSNENNVHTHLKNRTDIKFEINIPSLSPTTKLEPIPELPGFNDPLPENEDAKRAVIGSALIPCVLVNDSISLADKIKEYPYYVLEYRQYWHLLWSDVFTAGSNKIKTEVTGIPSEAQEKMKEFVGASIRTDIGLRFNEKSEPFGKQITSGLNVKHSYDYELGETTTTTNVDNPNDFTVRYARYARAHEFVLKRSDGQVVEEPWVAIDENDMYLKMYKRA

SEQ ID NO: 193 - protein, 337 aa, Artificial Sequence
  Synthetic variant of native sequence
MAESLSSPVSFTNIYNDGADYTKENLAKDLRKRILWGIEETPELRQKFKLADDESIQRENPATSFTDPNGNTTEYPALYYGLEDQLSKVEVGVVGSHFEVNPTVDSYEDLGQTNLLTINNDDGTVAQTAQTPETTEKFSETMSYSNSTGMKIGIGTSTTIKIKIPFDLGEASQTVNMNSEFSFNNTQTQTSTHEKSVTFKSQPVVAAPGGTTTYYGTIKRAKFSGTFQTDAYVPGLTLKLPIVKKNNGNDIVHTEEVTLTPEDMYAIFKNGLPVLPPYLSLDDKIKKVKVNNASFTFNGEGGYYSAVQVKFIPKDPNKKAQVMPYKEYVAKTQEKSL

SEQ ID NO: 194 - protein, 333 aa, Artificial Sequence
  Synthetic variant of native sequence
MAETQLNVGQKAVTPDVSSYIDIVQDRMKQRDKESKLSGEAINMQEQIIDGWFLSRFWIFKDQDNNHQTNRFISWFKDNLASPKGYDQIAEQMGLNIEALNDMDTSSINYTSKIGDTIYNGISELTNNTGTTQKMKTDSFQRDYTKSETTSVTNGLQVGFKVLAKGIIYLAGADLEASVNYNLSTTTSLTNTVSDKFTVPSQEVTLPPGHKAVIKHNLNKMVYSGSHDLKGDLKVSFSDKELVQKFIYPNYREINLSDIRKTMNEIDEVNNVNPVDFYQLVGVKNHVKNGDTIYIDTPAEFTFNGANPYYRAIFTEYDDNGNPIQVKSLGGNL

SEQ ID NO: 195 - protein, 370 aa, Artificial Sequence
  Synthetic variant of native sequence
MSNENNNRRNMNASMGSDGESIQNKIGDSRSQISFPDFNFYKIRTFSGKYADITGDSLLVQYNGHNGDNQKFLIVTLDNDYSIIAAKHTGKVMHEFYLFGTGRFLQADFHNMDEQKFFISDDGTIAVKKDRKVWDATGGTSNGSPIIPYDYHGASNQKFTLERSGSVSVTKPTIGTLPPAPDFKTTDLNEILPDNTEPVITHATYLPYFMVKDPYYNNQQKMQNSPYYILVRRQYWEKITQRIVGAGESYKYEQKTGVSRTDQTSMTETTEIAIGADMGFMFKGFSVGLSTSITKTLSVTKSTSTTESTETTEIVTDSNPFMHTIARAKYMLINEYYVTRANGEKITSGDAAYWKVPNPSQTATRTIPRT

SEQ ID NO: 196 - protein, 241 aa, Artificial Sequence
  Synthetic variant of native sequence
MRNYTSEKQSQTVLFSEKSIETFSRSTTEGYKVGSSIKSTTSFKVKVGFLVSGEISESIEVAVTGEYNHSSTETTTTTTTTTEKLWQVTQPVIIPPHTQITATLQIFSGPFVVPAKTKATIQGKGTINGTPNWASFINYTKYDGRYWAAYNRASGLYNDRNSWPGYKKIYVGTGSGTGSLRLEGEARINAQVGLYAVTEFKESPLPGYESVGSNRTYYAPNIILGDGSIIQFPEYQRYLQR

SEQ ID NO: 197 - protein, 297 aa, Artificial Sequence
  Synthetic variant of native sequence
MDTMPQAKVAPHVTNFAAADHYQQFMDFMSSKGMERYANNFEIVAMPDSGPKNIRITEAKPINAPENTTQVMSYHNSTGVQQSLKTPSKKITHKNTIAIKNGGSIKTTIESKTTFGVQVPFFAKGEQELKVGLEVTYNRESTDTAENIQEFTVPEQTLLAQPGGTTRLIYTVKSTAFSGTYTNKAIFKQKQDGISKKFENGKEIEGKELESWNETQGYRFIKQIIASQPQLADIFEMDDANEKAYLKEAVFTFEGQAGHQSTAEAVFIPDDNKKSEVKMPIAEYNKRVANGISLYAK

SEQ ID NO: 198 - protein, 287 aa, Artificial Sequence
  Synthetic variant of native sequence
MIHDLKEDILNFTKWYAEKHYNANPDTFHDEKVFNPSVSNTEVVPDKIEFDTTPKLTARATDILINDTSVSQSITPKISTKTVETTSITTTEGYKIGAGIKYTSTMKLKLFLIGEISNSIEIAVTSEYNHSTSETQTNTTEKIWEYTRPVIVPPRTKVTATLEVYAGPVKVPVTLRSTITGMGIASTGYGYILGSVAYKDRDGKNWVDSWRSRSLYDFKSTWPGFKPVYVGTDGEYGVKVQGTAQVELELGLYGVVTYQEEPLLGNDSNKSQTYREIMSRQGLYTRI

SEQ ID NO: 199 - protein, 307 aa, Artificial Sequence
  Synthetic variant of native sequence
MKPSQTYAESNSMQEKTIGITNVNQVLEKIGNYYYQRNLSLTWYEAPNSIGVKHNFQLRKNSDSISSEIDLSISGEEIESLYYDSTIPKFLGENVFENNTDQEQSYNTSKFSETYTESTSTSVSKGFKINVGRDFTIPLILNEGGKINLEYNSGSTNTNTLSKTYTLEVPSQPVKVPPNKIYKSVVEYSQRTYKGTVKFYGRNLHNPHPINTIKTTGSYTGWMGMQEIKQFTFNDPLYKHYDGLSDSQKKEVENDGVVIIPFLGATYVVVEGKGSFEGVYGAKLNVKTYDITDKNNIKLVDSRSIDL

SEQ ID NO: 200 - protein, 441 aa, Artificial Sequence
  Synthetic variant of native sequence
MYAHKQPFFFSFLNVQSSAGDYHYSEFQRYSAQYADHCELVVNNQLNKIQNTTGKTWKDYNEYRRKMILSVFDIVAEFSTFDPILYKGAINREILTRKIYTDPVNFTPGSSIANDENKYTVPPSRVNQLVASTLFTNVASAQYAGFIGNINRYLSLSRGEPFDGPLIGNQVYEKVLAGVPTNQSIYEVGVEGIQNDYPRNIGLRWGSLTAFQNFYAGGTTNLGSLTRVSVPPKNNDPINITNFTHQLSDIILPGNSGSSFAWTHVEVNPTGNYLSTNQINLIAGTKASESPQIKKGPRFIGGDLLTADWRTGNIISPSYQLSPKFPGTRTSFRVRVRYGANSSGSMQFTFGATTSSQLAYTATGYSPTNTKYNQFRTIEFFTPLEITTEGKLILVLYNTNSAPTFVIDRLELIPMIGLPTEYNEPQKLETAKKAVTDLFTN

SEQ ID NO: 201 - protein, 415 aa, Artificial Sequence
  Synthetic variant of native sequence
MYAHKQPFFFSFLNVQSSAGDYHYSEFQRYSAQYADHCELVVNNQLNKIQNTTGKTWKDYNEYRRKMILSVFDIVAEFSTFDPILYKGAINREILTRKIYTDPVNFTPGSSIANDENKYTVPPSRVNQLVASTLFTNVASAQYAGFIGNINRYLSLSRGEPFDGPLIGNQVYEKVLAGVPTNQSIYEVGVEGIQNDYPRNIGLRWGSLTAFQNFYAGGTTNLGSLTRVSVPPKNNDPINITNFTHQLSDIILPGNSGSSFAWTHVEVNPTGNYLSTNQINLIAGTKASESPQIKKGPRFIGGDLLTADWRTGNIISPSYQLSPKFPGTRTSFRVRVRYGANSSGSMQFTFGATTSSQLAYTATGYSPTNTKYNQFRTIEFFTPLEITTEGKLILVLYNTNSAPTFVIDRLELIPM

SEQ ID NO: 202 - protein, 192 aa, Artificial Sequence
  Synthetic variant of native sequence
MAASFRTVVEVAQDHLAQARSIDRVFQEAIAPATVNFDFEAIHRAASAVPDSDVVKMVRGWGLQEHAPVLVMVLSLKEAVRQALPPECAEAGFWATVERELVQAFTGLAAQEGRPGLSFYEESGDRTRFYRDLFFALQDEETGDHMYALAFCVDVTVELPKAETLALDLTDVVSFAVRLNAIVVRQALAVSV

SEQ ID NO: 203 - protein, 319 aa, Artificial Sequence
  Synthetic variant of native sequence
MTNTQMDNKYLFRPSYEAKPDGTTVNPYYIIINDLKRWPCYVTDNRNFISSSEELQTRVAPSYDPTGKYDGTPSADFNRVYRDYALDPAFRPLYAINAQILPKYNYWHQGNWQYNELGRVSQLGQDIQNFANLICVKYINELNQIIDDTQNDKLSQKDIDTFKNICSDLQSQIGPCQRRSRNIYNEYQNAINILLSQSHHDAANYAFTIVDNAYSTAKSGDQNALGGIRSYASSVLNYANAYDQGVITASMNLQGMWMFFGDNLQELISNLKDPIVDHNALIASLQLEIAIEEWQNVSTNAAEFIKEWAGYGASLGYDC

SEQ ID NO: 204 - protein, 307 aa, Artificial Sequence
  Synthetic variant of native sequence
MSIYNYRITSWFGDRSILPSNETLQQQSWTGEAKQKWNLRDLGDYSFEIVNQANGKVPTYQWAGSLVDNVEYLKLDYSNPSDPDKVFGIINRSFLFDGTNYAIHAEDLVKIQKLPDVGTRPDAPNYTGGVDQQLPQVSDSVVVGASLIPCIMVNDNQASDYTKIHNSPYYTLVKEEYWDKTYSAVIPAGVTHKYSFTTGMSSVDQQKMTDTLSMSIGADFGLSFGAASASLKTEISRTIQTEISSTNTNASEENVTRDVQSEPGKTTGFTEYQLATRYTLKRADGSIVSDPWVVKNNKITITRKNAQ

SEQ ID NO: 205 - protein, 295 aa, Artificial Sequence
  Synthetic variant of native sequence
MDQINTSENNLQREVKAHTILDWKDPIFNATEIVGKNLLVPGIYLFTNSTYHHMGYYGVKYEQFSVEADGSPSHTNSTSIFVGKTTLTNITDQEQTLSTNSFSKMISNSVSNSTTHGFKFGTKASAKFQIPFVGETGIELSAEYNFSDTSSTTNTESYTYIASPQNIKVPAHSTVEVLVNLNTVKAKGNVKLLTKVSGRDQGVFVFDPQTGDISKSYYYDLHFNQIVEKASKFEKLHNISSNSDGNTVNIIGSGKYEAEYGTEFSVTVRPVDNKGRSINGGYTFNVKPEKIIKVE

SEQ ID NO: 206 - protein, 315 aa, Artificial Sequence
  Synthetic variant of native sequence
MPPQVYAEASIAQEKSIGIVDVNEVLKKVGTYYYKNHLANTVANPESNGFRYTLRANPDSVTPVIDLSIEARTENIHYDSTIPIFIGENTFPNNLDEEQSYNTLKYSKTYTESTSTSISSGFKVGGAGDLGNKFILPLILEGAGKINLEYNTGSTETNTTSESYTLEVPPQPVKVPPHKTYKTVVEFSQRTYRGDVVFTGRTESTMANRSIINATGIYTGWMGMQDSKKFTYDNYLGVHYAGLTASQQQEIKNAGVQITTSGYGAAANRFSSIEVTGKGSFSGVIGAELIVTTYDVTDAKNARLVNQRTVPIELD

SEQ ID NO: 207 - protein, 653 aa, Artificial Sequence
  Synthetic variant of native sequence
MKRNKDCNDGIQKSDMSDRYPYANDPNAALQNMEYKEWLSVCQEGGQQVLHLESVGNETVNAVSAGVIVVGTMMSAMSAPLAIPGGILISFGTLAAALWPDEENPTKVWSDFMKHGETLFDKKISELVKKQAQAHFEGIKTLLVDYEKAFNDWKENKNRLTAEKVKREFNDVDRQIKTVIPHLKYEGYEALLLSCFAQVANLHLNLLHQGAAFGDEWDKYSSYLSTSEDCYEDLMSRIETYINHCTKTYNDGLIELKNKPNIKWNIYNTYRREMTLTALDLVALFPNYDVKKYPIGTQTELTREVYTVLNSMDDLVDFEAAEKSLIQNPHVFRWLAGFTFVTKNISAIDLKYLSGIRNWYYYTNFDTLKADKANSENSGGGSQKFFFGAGSIYKLEIIRNMDDHWGGLPFANEVQVFTPSITYDNKQSQTNSVYNKKGDASSGIPIMDLLYLPKAKDDSPFSQQDIPSANNYSHRLSYIARVKKIRGTRDVYNYAFAWTHRSVNRHNTIAKDVITQIPAVKALEPNKDFDVIKGPGHTGGDLVKLNYNETSGLEIKCLTENHPKIDYRIRIRYAANEDTRVEIIVPESDGFGSIKPAKKTYSDDNYQKYNSFQYLDTRAVVYGEGKQVALSIKNLEPDTFILIDKIEFIPWFG

SEQ ID NO: 208 - protein, 291 aa, Artificial Sequence
  Synthetic variant of native sequence
MTENTPTSVNENVKVGVTDVQSELKKIGEYHYTNNIAGTKIESWPTLTFGSRPDSVETKVNFSITGTENKLNFDSKIVEYVGENIFENTTEQSQKFSTAKYTKSVTESIATATTKGFKVGGSGDGSNIFTIPLLLNNGIKINGEFNSSTTETKTKSETRSIEASAQSIEVPPHKKYKADVVLEQRNFWGDVTFTGVGVKPATTIKGTASYWAPNGMGAWKQYTFSDNTVNYWKGLTASQKNSINGIKFENNDVKAEGTAKVEGTFGSMLIVKVYDITDKSNPKLVETRSFK

SEQ ID NO: 209 - protein, 369 aa, Artificial Sequence
  Synthetic variant of native sequence
MTFKVGMKYMFKNKNSRKYLDIEGNQTGNNANVQQYEYLADALSERFFLHKLDDNYYAIINLNSGKVIDIRGNQTGNNANIQQFEWRGDANSEYWYFRREEDGYYVIESKHSGKVIDIEGNQTGNNANVQQFQFLKDAPSERFAVEEAGSVSLPSINTQPLSPVPQYETINDQLPEETERVVTAFTIVPAIAVKDPHYGGDTAKQIKENPYYMVVKKQWWKKQESYVLAPGETYNFEVTTGIRVTDQETATKTVSLSIGADMGFSFKGVSLGMSSQYSQELQTSISHTTEQLKEETKRHTITNLFSERMAYSRYILTTEYSVRRDSGTIVNSSWTMTDKTRTHAVTFPKSTGKVLNENIKQISKSESLK

SEQ ID NO: 210 - protein, 466 aa, Artificial Sequence
  Synthetic variant of native sequence
MFAEEKDKNAPQQQNTIQQKDAGTYYEGEQKELNPLAQLDKWTQDLGKTSGAGDYKTTLGMVEKLLPTIYKDLNSGNFNNTARSFTMLSTALIPYGGAFISPIVGLIWPENTTAQDAKLQKMVEGLTSMMGQKINDYDLAKLKQKTDALTNTLKKFQDSVNNKPQSESYYDNIQTANVTYADYINTKFEEIIKESQTPGHQIPELPIFTVIATAHLQFLHFIEENAVKNPRIKMDPEHLNRYFPKFKDTARKYRKYINDVNHDAQQWLYDFTGGGHIKANNPAHIEAMNKIADLTKQTSDNEAFLLASNPPSVGDKTGLVKEDGDKWHYYSPRDGFENSQHQKFNKGSLVTGPLDIDGRTYLFSFEEGMKNSAGKKFNKGDMFTGWYNDAGVWSYYKPESGVMATDWQNISGKWYYFATAYQEFNGGAFISKGDMIKGKTVEISGKLYTFDENGACLNPDGKPIAK

SEQ ID NO: 211 - protein, 1876 aa, Artificial Sequence
  Synthetic variant of native sequence
MASLADLYPSYYNVLAEPPFINGDNDIIITAKSDCKEDSASEAAGNSNKNNYWAGAQSTWKCYWQSGYQDAYTGVISAAFSDDNFNYVDFTKKVIGLNGFFISWLGGEISEELRSTLNGAEKALEVAGMVTLPIVVPIAQALVMAIFPISVTKKKREDQAKTLWDLLAKRVDEEIKDLIKDYDANALNQFIAGFQTVLKDLSDAVQIAICQPIDLNPDIPSKVNPNCIPYTDIELVNNVKQKLSTVDSAFTTLIPQFQKSDYASAELPQFCLAATLHLSTLHSAIIMSEPWELNPNIRKSYIRKLRRLIKSYSLYVTQVVTKASQDYLKQNSAGNLTKKGFNEYNQLLSFYVTECLDYVAMWRFLDPIDYPLPTYAELTRVIVGNIVGPYEEDNTVGGNATPISDDLRPKIQIFDPTSQDFKELSNSRMYDLLGLTYNNLQMKNVTMHSQGDSRNVVVAGEHLEYMYYQDSLTKDFGNTTGHSVFSDVSLNPATYLNMESAYNNVNNVDQTELHICKMNGDIDIVGAVDFETCNAHGGKGLGTRCTSNNKPLGIDKIQMIYPVTVESIAGNQAKMGFVATHVHDIVTPENIIGQKMQDNDGNDTDQPLLQIRTISVEKGKLSGNARPIKEYVTGSNPVLIPPGGSIDLTCTNLTAQKYFIRFCLSTMSDALSLQWQLNNGQTQVVSIPTATSNFISNDQKGISGLSLNFGPYTADNLYAVFPETTFDDNGLPILPDESHAVEIGDGEFTVTITNPAPSVSNDSNDITVDRIEFIPYIEQPAPELQKYLMDTLSNIQPFTVGLNQPTIIWSSTDRVATELDMRYEGYHPSFINSNPRLDFYYNNVLQTAIRSETPDIYGYYNYTIEGNDTDKTGGFDRVELIANTTNLETITLSGKVYGPNQQYKPTPPPTPPTPPTPAATIVDSVPFVVGKGANKTIWSSTSIVANQANLKLVAYQPDFITYDYQFAFYYNGVLQNSIQTRDPKGFDMYAVSSGFNSIALISKAPNFETVRLSGNIYTPQTPPPPPPPTPLPAATIVDSVPFVVGKGADTTIWRSTSIVANQANLKLVAYQPDFLTSEHQFAFYYNDVLQKVTLTGQDSKGFDIYSVSSGFNSIALISQVPNFETVRLSGDIYAPQITPKPPTLPESVGGFSTPKSLDIPVNTSSEVWRDYTVYGIQAKINTRFLDSPDRNITYWYQFYLTSGEGQNDTLVHEEKAKSGDYEYIVNHYFNKIVLHVTGFYPVSEPSTSSVTIESCAIYGYERQKIDPSVNKTIEPMDTFGRKSIEIWTPTKPTAKGFEAILGVDVITMGAWSSDTVYQFYLNGQLVTEQPVDFTNLMKNVYEVPQGFNSISIFDPNAYDPDDPDDNGNYPLTGDEYNITIIGTIFGDASSSNLPPENPVDGTMFTTREAFMTIARLVYALFTTSSQTTLNLTITDYWIHQLVMKVNKLSNEKFGIEKKELLKLLSKAKQILKGKNFLRNGSFDTLDNWQVGREVAAIYGHELFQGNYLFLPPPTLAPSYAYQRIPESRLKKNTRYKISGFIASSLELELIVSRYGKEIVKTLNVPYGKALPVSPDAHPNCCNHNLCGCPSCIGNGTNKHFFNYCIDVGTVQTITDLGIEFGVRIKKGNGYAKLGYLEIQEERPLTPQEVQNVQQKELKWKETFLQEKQQITNLLNPIITKINAFFKNKDWNSDILPHVTYQDLSTIIIPKLPKMTHWFMTDRVGEHYEIMQKLQQALQRVRTHLDAENLIHNGDFTDGLQNWEIQGDVSLFAPGILQLSDWDASVSQTIEILNFTAGQGYTLLVNSKGAGSITIEHGQVVETLHMMSPNFMTKTLTFYPVSPTLEIQILSDGAELLVDSVTILQNPIENSDATSCE

SEQ ID NO: 212 - protein, 776 aa, Artificial Sequence
  Synthetic variant of native sequence
MASLADLYPSYYNVLAEPPFINGDNDIIITAKSDCKEDSASEAAGNSNKNNYWAGAQSTWKCYWQSGYQDAYTGVISAAFSDDNFNYVDFTKKVIGLNGFFISWLGGEISEELRSTLNGAEKALEVAGMVTLPIVVPIAQALVMAIFPISVTKKKREDQAKTLWDLLAKRVDEEIKDLIKDYDANALNQFIAGFQTVLKDLSDAVQIAICQPIDLNPDIPSKVNPNCIPYTDIELVNNVKQKLSTVDSAFTTLIPQFQKSDYASAELPQFCLAATLHLSTLHSAIIMSEPWELNPNIRKSYIRKLRRLIKSYSLYVTQVVTKASQDYLKQNSAGNLTKKGFNEYNQLLSFYVTECLDYVAMWRFLDPIDYPLPTYAELTRVIVGNIVGPYEEDNTVGGNATPISDDLRPKIQIFDPTSQDFKELSNSRMYDLLGLTYNNLQMKNVTMHSQGDSRNVVVAGEHLEYMYYQDSLTKDFGNTTGHSVFSDVSLNPATYLNMESAYNNVNNVDQTELHICKMNGDIDIVGAVDFETCNAHGGKGLGTRCTSNNKPLGIDKIQMIYPVTVESIAGNQAKMGFVATHVHDIVTPENIIGQKMQDNDGNDTDQPLLQIRTISVEKGKLSGNARPIKEYVTGSNPVLIPPGGSIDLTCTNLTAQKYFIRFCLSTMSDALSLQWQLNNGQTQVVSIPTATSNFISNDQKGISGLSLNFGPYTADNLYAVFPETTFDDNGLPILPDESHAVEIGDGEFTVTITNPAPSVSNDSNDITVDRIEFIPY

SEQ ID NO: 213 - protein, 609 aa, Artificial Sequence
  Synthetic variant of native sequence
MKYKERKDAKRKYKQALLTTVATMTLGVNTLGNTSSTFAAEEDNISVISTHTINNVGTQTDISEEAKKKTFFSKVSANLTTATGKKIVVAGEKELLNMIKTQKVDFNNASRALVGAIIDNAVPGGMFLSPLINTIWPENGNGEIQQLREELMKVMDEKITTSHMNSLKEEFRALNTIQNKFEKAVNEKNSQNVDASTKRTRSGWASGIEQAYMRLLALTSSNDFKVADLPLYTQIATAHIAFLTSLDTPEMAAKVDITTTGLKEFYNKGELSKLANEYMRHITETYDYAKREYINKIEQVGVAFDPSNEANQQADLNNRLHSAEKKLKDREGVLSTNPAMIWDNDPKYKKNKTEVTYLKDAKDAYPTLLKLYKLTVSDPNMAELSKGTWMEKSGKWHFTNKNGHDMLGWVQDNGKRYYISPENGTKNSAGDTFNKGEMVTGWKEVDGHRYYFSPKKTDTGNNHKPIAEGEMVTDWKEVDGHRYYFSPENGTRGYERPADNEKESPFKEFTKGEMMTGFIQRQSDYNWFFLSPEKNTQNSDGTTFVEGEMMTAWYSNPKDDKHWYYFSTSNQPDDSNSQRLESGQMAKYLNIGGYNFNRYGVCTNPNYKK

SEQ ID NO: 214 - protein, 571 aa, Artificial Sequence
  Synthetic variant of native sequence
MAEEDNISVISTHTINNVGTQTDISEEAKKKTFFSKVSANLTTATGKKIVVAGEKELLNMIKTQKVDFNNASRALVGAIIDNAVPGGMFLSPLINTIWPENGNGEIQQLREELMKVMDEKITTSHMNSLKEEFRALNTIQNKFEKAVNEKNSQNVDASTKRTRSGWASGIEQAYMRLLALTSSNDFKVADLPLYTQIATAHIAFLTSLDTPEMAAKVDITTTGLKEFYNKGELSKLANEYMRHITETYDYAKREYINKIEQVGVAFDPSNEANQQADLNNRLHSAEKKLKDREGVLSTNPAMIWDNDPKYKKNKTEVTYLKDAKDAYPTLLKLYKLTVSDPNMAELSKGTWMEKSGKWHFTNKNGHDMLGWVQDNGKRYYISPENGTKNSAGDTFNKGEMVTGWKEVDGHRYYFSPKKTDTGNNHKPIAEGEMVTDWKEVDGHRYYFSPENGTRGYERPADNEKESPFKEFTKGEMMTGFIQRQSDYNWFFLSPEKNTQNSDGTTFVEGEMMTAWYSNPKDDKHWYYFSTSNQPDDSNSQRLESGQMAKYLNIGGYNFNRYGVCTNPNYKK

SEQ ID NO: 215 - protein, 635 aa, Artificial Sequence
  Synthetic variant of native sequence
MNNVLNSGRTTICDGHNVMAQDPFNFQHKSLDTIQKEWTEWKRDDHSLYVAPVVGTVAVFLLKKVGSFAAKRILNGLWDLVFPNDNTKLMQDILRETEKFLNQRLNADTLSRVNAELEGLQKNVAEFNRQVDNFLNPNRNPTLLSITSSVNTMQQLFLNRLTQFQLRGYELLLLPLFAQAANLHLSFIRDVILNAEEWGISAATLRTYRDYLKDYTKEYSNYCINTYQTAFKKLNTPLHEMLEFRTYMFLNVFEYVSIWSLFKYQSLLVSSGANLYASGSGPQQKQSFSAQNWPFLYSLFQVNSNYVLTGFSGSRSTVKFPGGGGLLPPGSTTTYALHSARANYKEGVSSGIIGGTNFNHNFKCRTILPPLLTPFVRSWLDSGTDREGVTTFTNWQTEAFETTFGIRGGAFGPRGNANYFPDYFIRNISGLPLVVRKEDLTKPLHYNEIKNIESPSGTPGGARAYMVSVHNRKNNIYDAHENGTMIHLAPDDDTGFTISPIHATQVNNQIRTFISEKFGNQGDSLRFEQTNTAARYTFRGNGNNYTLYLRVSSQGNSTIRVNINGRVFNVPNVNTTTNNDGVIDNGARFSDIRIGNIVASNNTNIPLDINVTLNSGTQFELMNIMFVPNNLPPLY

SEQ ID NO: 216 - protein, 360 aa, Artificial Sequence
  Synthetic variant of native sequence
MAENHLEVQQINSQQERASDTLSLSLRRVGSNSALLQGYGLVILQQSNITLPAMGSLTTHQKIAKTNVKEWLDEHNPKLIALNQDIKKFSTKFNGYYQTLYDLAGQVNENEQEKQNFEKGLSTLKDQGQNTKSTMNDTLSKFKDFKTLLDDDVEKFSTAASDAIQSVQGPGGDAIQLRENIKKLQQDIQTELTNILNRPSEIINGSINFGKKVYTIGMSSAESQTIDLVSIQSLTGDLLDLSDHKIKESANKIDAINNELVLLTKNLSDMLIQVTGITFIEDQVTGFAGMIDRQITTLEFLMKDWDVINEKINQIQSNLDSGANSGLLKDQLVELKKLNDEMENQSKQFEDFLTVEITQI

SEQ ID NO: 217 - protein, 507 aa, Artificial Sequence
  Synthetic variant of native sequence
MNTHGKNEEWNQHHDGTCGCQQNKQDYGYEQIPEHDKQQYASHEYKNQEYTYKDSCGEIGTGYHNENNGDFQCDTIRYTTPNLPVESTRFQTITNINTNDNGHRVMDAMNIAVGTGLEQRVGGCPWQIDVENTVVNEQVRFNNQSQLFVFYQTDSGQFVIANRGNGRVLEMVEFPNSDPQWHQLLISSFYENRRNQLFDRRIINNTDFLLTTITETGSVFGVQNCNNNPNAWQIYTTVNENESVGFRNNTYRFRTENNLPINIPPLRSGEPLGPLPALRYLQDSGLSPAEAPRAVIGSALLPAIFVEDVLSLPARMAQSPYYVLEYRQYWHRLWSDIIPANGQSWFNETTGMLGGAPQQGNMRNTISMSIAPDLGIRFGTQSMPFSIKIAEGLGRQRSNANIDIGETSQNIRYDNPQNQPTRFARFALAHEYALLRMDGRVINRWTVVDRSSMYLLSFPQNALLTMQCDKIIRTDNSYDLSVWKTPMQIKSGQVITKNEKNSKPYNA

SEQ ID NO: 218 - protein, 457 aa, Artificial Sequence
  Synthetic variant of native sequence
MDLSHANHDTDNQIYKTSCECNQKTEWPMSKKQEQTHTDTHYKATQFNSPIWNLPIESRRFQTITDVNSSQGRGLNALRTYPGQLLGGDLGAFCRTVTLQNQVVNDLTRGNIARFLFYNLDNGGFVIANANVGEVLQEMNANNSSLITNTYTGQTNQFFRKSPITQDHFRLLTNENMIVGPCGNNASNSWTRITLALFSNQNFRYRHEPSENQPINLPQAAATSELAPLPALTSLNDPGPSPVVAPRVTIGSALIPCIFVNDVIPLQHRIRQSPYYVLECRQYWHRIWSDVLTAGSDAFYEERTGISDGAQIDIRNTMDISIGSDWYLRFGSLSSPFRGQISSGLRTQPSFSNIDLAETVMINRHINPNSFTTRFSRFTKAIEYRLLRMDGTVVRSWVAVDNRSMYWKTFPNNAQSTMQSQKIIQSDTSYDLSVWKTPMVIRDGEIIEKNDHNSKTQ

SEQ ID NO: 219 - protein, 948 aa, Artificial Sequence
  Synthetic variant of native sequence
MVTKAMTPKLGALPDFIDDFNGIFGFMDNITGVMSTIFGVDTGDSSIDNVLNNQELLQEMLDQMSTMQSSIQDILEQQGISADIEKQILALTTDLATSINTELGKIEGILNTYLPAISNMLSNIYEQTSLIDQKVDKLLALMTFALKELDYIKDNVVLNSSIVEITPHVQKLVYVNKKFLSLTRGFLQGEDVSIDSMQEIQEWAKSILATEMNSFEFSVDTLHNIIIGDNLYKRSALKTFSDVLLDDADQYGDFGTPLAKFYTFFSSLATLQINAYLCLTFARKVLGLSEIDYQVTMQDRIEQQNQMFVNLIQDKNYSNALEITGIYPMSVDWGDCKSTDLQADAGYALIGLEFFMDNGIYKVKAYQGKIGKNFSVSGDTVTEIISDDLSTVFNDMTNDNPELDVVYPLSGELTGPPNTIITRIGFGTKYDKTRESSVQAFAYIDADFSPYDYISGTISKEGTQTVSLEGNDHKNRCYSMWPIGLIGDLYMTPLKSLSLNVDVDDSSAYGTILNMSGESYFSTILSREYNTNFILFPYTNNSGLIDENLIQNGNLEEQDKYWEGTEPSFFAEGEGTFGSNALKVQAQGAFDQIVKLEPNTTYRLTAFTKVKDSNYSKGRIGIRDMYNYRVEKSFLHTRYKQTKVEFTTGADTSKLSVFIQGGGDQESIAWADNIELYKVHQQDNMISDFDFDTYKYSNMCWKLSGGGDFVEKEGLFNSKALKITNSGGAEQEVKLKANTNYILTAYVKVDVPTTTAQIGCGSNQVPCNSTSYTPVKLKFKTGEDPSTTESSVYCSNSNDSGTVWADNFVLYEAPNLIINGDFEQFDQSSWNFSPSEGGRIYLQSGLGMSRSNAVVLHGQNGQISQKVPLKPFTKYRLTAYVRVSDGGTAWIGYGDYGASCTSKEFKQISKDFTTGANPLQSDDAIYLSSDNSKYTVADNFELYELDQI

SEQ ID NO: 220 - protein, 345 aa, Artificial Sequence
  Synthetic variant of native sequence
MSEIEQPSTGDMSLSANEVKMKEALQKAGLFAKSMNEYSYLLINNPDVNFEGITINGYADLPNKIVQDQRNARAHAVTWNTQVKRQLLDTLTGIVEYDTMFDNYYDTIIDAINTGDGDTLKEGITDLRSEIQQNQKTAQNLIAELTKLRDNMGEDVRAFGSNKEQLYSILKNQTAGLEDDQKRLDEVLGQVNYYKKLESDGFTTMKVGVFGLWWIGGIIVGTARDNLGKLEPYLAEVRQTVDNKTTLNRVIEVAHNNTDQMHKSIDNAINALEYMHTQWTDLDNQYAGVLQKIDNAAGKADQNKFAYLKPTLKTAKDLWKRLNEDAVIIKEGIKELKVEPVTPQK

SEQ ID NO: 221 - protein, 264 aa, Artificial Sequence
  Synthetic variant of native sequence
MVTKVMTPSLKSLPDFIDDFNGIFGFMGNISDIMSTIFGIDVGGNSDIDDVLNNAELLQQMMDQMNSMQGSLADILEEQGMSIELIQKLTSLSNQQLALSTPINTELGKIEDILNNYLPAISNMLNEVYHETVQINAKVDKLLSLMMYAMKELDLIKDNVILNSSVVEITPHVQKLVYVNKKFLELSGNYMRSDISIDSMQELLQWAKSIVDTDMNSFVSTDTPGNKVFCSIHRAVVKSNNIFGRSLCNQARVYNHLIRRQCPG

SEQ ID NO: 222 - protein, 288 aa, Bacillus sp.
MSIYNVEADLFDLCREYAIKHYDANDATFHGATIYDRSVLNSEVMPDQVEFNVIPDLSNTVINTITNDTSIEQSMSTKLATKTIETTSFTTTEGYKIGTSIKNTLEFKAGGLFSIGGVEHKFEVSVSGEYNHSSSETTINTTEKLWEYTAPIKVPPKTKVEGKIQIYSGAIPVPVTLKSTVLGLGQSPNGKLKNALTSLWYKDRAGKEWVDTYQTSHLYTLREEWSGYKPIYVGSDGNGVKLQGKGTVGLDLGLYAVVTFKEEPLSGNYSMGNERTYSKVIFRDGRVI

SEQ ID NO: 223 - protein, 293 aa, Bacillus sp.
LLGGETMIHDLKEDILDFTKWYAEKHYNANPDTFHDEKVFDPSVSNIEVVPDKIEFDTTPKLTARATDILINDTSVSQSITPKISTKTVETTSITTTEGYKIGAGIKYTSTMKLKLFLIGEISNSIEIAVTSEYNHSTSETQTNTTEKIWEYTRPVIVPPRTKVTATLEVYAGPVKVPVTLRSTITGMGIASTGYGYILGSVAYKNRGGKSWIDSWRSRSLYDFRSTWPGFKPVYVGTDGEYGVKVQGTAQVELELGLYGVVTYKEEPLFGNDSNNSQTYCEIIPRQGLHTRI

SEQ ID NO: 224 - protein, 287 aa, Artificial Sequence
  Synthetic variant of native sequence
MIHDLKEDILDFTKWYAEKHYNANPDTFHDEKVFDPSVSNIEVVPDKIEFDTTPKLTARATDILINDTSVSQSITPKISTKTVETTSITTTEGYKIGAGIKYTSTMKLKLFLIGEISNSIEIAVTSEYNHSTSETQTNTTEKIWEYTRPVIVPPRTKVTATLEVYAGPVKVPVTLRSTITGMGIASTGYGYILGSVAYKNRGGKSWIDSWRSRSLYDFRSTWPGFKPVYVGTDGEYGVKVQGTAQVELELGLYGVVTYKEEPLFGNDSNNSQTYCEIIPRQGLHTRI

That which is claimed is:

1. A recombinant nucleic acid molecule encoding a polypeptide comprising:
(a) an amino acid sequence having at least 90% sequence identity to the amino acid sequence set forth in SEQ ID NO: 198, wherein the polypeptide has pesticidal activity;
(b) the amino acid sequence set forth in SEQ ID NO: 198; or
(c) an amino acid sequence having at least 95% sequence identity to the amino acid sequence set forth in SEQ ID NO: 198, wherein the polypeptide has pesticidal activity;
wherein said recombinant nucleic acid molecule is a codon optimized sequence designed for expression in a plant.

2. The recombinant nucleic acid molecule of claim 1, wherein said nucleic acid molecule is operably linked to a promoter capable of directing expression in a plant cell.

3. The recombinant nucleic acid molecule of claim 1, wherein said nucleic acid molecule is operably linked to a promoter capable of directing expression in a bacteria.

4. A host cell comprising the recombinant nucleic acid molecule of claim 1.

5. The host cell of claim 4, wherein said host cell is a bacterial host cell or a plant cell.

6. A DNA construct comprising a heterologous promoter that drives expression in a plant cell operably linked to a recombinant nucleic acid molecule comprising a nucleotide sequence that encodes a polypeptide comprising
(a) an amino acid sequence having at least 90% sequence identity to the amino acid sequence set forth in SEQ ID NO: 198, wherein the polypeptide has pesticidal activity;
(b) an amino acid sequence having at least 95% sequence identity to the amino acid sequence set forth in SEQ ID NO: 198, wherein the polypeptide has pesticide activity; or
(c) the amino acid sequence set forth in SEQ ID NO: 198;
wherein the nucleotide sequence is a codon optimized sequence designed for expression in a plant.

7. A vector comprising the DNA construct of claim 6.

8. A host cell comprising the vector of claim 7.

9. A composition comprising the host cell of claim 8.

10. The composition of claim 9, wherein said composition is selected from the group consisting of a powder, dust, pellet, granule, spray, emulsion, colloid, and solution.

11. The composition of claim 10, wherein said composition comprises from about 1% to about 99% by weight of said polypeptide.

12. A method for producing a polypeptide with pesticidal activity comprising culturing the host cell of claim 8 under conditions in which the nucleic acid molecule encoding the polypeptide is expressed.

13. A plant having stably incorporated into its genome a DNA construct comprising a nucleic acid molecule that encodes a protein having pesticidal activity, wherein said nucleic acid molecule comprises:
(a) a nucleotide sequence that encodes a polypeptide comprising the amino acid sequence set forth in SEQ ID NO: 198;
(b) a nucleotide sequence that encodes a polypeptide comprising an amino acid sequence having at least 90% sequence identity to the amino acid sequence set forth in SEQ ID NO: 198, wherein the polypeptide has pesticidal activity; or
(c) a nucleotide sequence that encodes a polypeptide comprising an amino acid sequence having at least 95% sequence identity to the amino acid sequence set forth in SEQ ID NO: 198, wherein the polypeptide has pesticidal activity.

14. A transgenic seed of the plant of claim 13.

15. A method for protecting a plant from an insect pest, comprising expressing in a plant or cell thereof a nucleic acid molecule that encodes a pesticidal polypeptide, wherein said nucleic acid molecule comprises
(a) a nucleotide sequence that encodes a polypeptide comprising the amino acid sequence set forth in SEQ ID NO: 198;
(b) a nucleotide sequence that encodes a polypeptide comprising an amino acid sequence having at least 90% sequence identity to the amino acid sequence set forth in SEQ ID NO: 198, wherein the polypeptide has pesticidal activity; or
(c) a nucleotide sequence that encodes a polypeptide comprising an amino acid sequence having at least 95% sequence identity to the amino acid sequence set forth in SEQ ID NO: 198, wherein the polypeptide has pesticidal activity.

16. The method of claim 15, wherein said plant produces a pesticidal polypeptide having pesticidal activity against at least one of a lepidopteran pest, a coleopteran pest, or a hemipteran pest.

17. A method for increasing yield in a plant comprising growing in a field a plant or seed thereof having stably incorporated into its genome a DNA construct comprising a promoter that drives expression in a plant operably linked to a nucleic acid molecule that encodes a pesticidal polypeptide, wherein said nucleic acid molecule comprises:
(a) a nucleotide sequence that encodes a polypeptide comprising the amino acid sequence set forth in SEQ ID NO: 198;
(b) a nucleotide sequence that encodes a polypeptide comprising an amino acid sequence having at least 90% sequence identity to the amino acid set forth in SEQ ID NO: 198, wherein the polypeptide has pesticidal activity; or (c) a nucleotide sequence that encodes a polypeptide comprising an amino acid sequence having at least 95% sequence identity to the amino acid sequence set forth in SEQ ID NO: 198, wherein the polypeptide has pesticidal activity.

* * * * *